(12) United States Patent
Cole et al.

(10) Patent No.: US 12,241,067 B2
(45) Date of Patent: Mar. 4, 2025

(54) COMPOUNDS AND METHODS FOR REDUCING LRRK2 EXPRESSION

(71) Applicant: Ionis Pharmaceuticals, Inc., Carlsbad, CA (US)

(72) Inventors: Tracy A. Cole, Encintas, CA (US); Susan M. Freier, San Diego, CA (US)

(73) Assignee: Ionis Pharmaceuticals, Inc., Carlsbad, CA (US)

(*) Notice: Subject to any disclaimer, the term of this patent is extended or adjusted under 35 U.S.C. 154(b) by 0 days.

(21) Appl. No.: 18/523,746

(22) Filed: Nov. 29, 2023

(65) Prior Publication Data
US 2024/0360453 A1    Oct. 31, 2024

Related U.S. Application Data

(63) Continuation of application No. 17/712,822, filed on Apr. 4, 2022, now Pat. No. 11,873,495, which is a continuation of application No. 16/972,822, filed as application No. PCT/US2019/039558 on Jun. 27, 2019, now Pat. No. 11,332,746.

(60) Provisional application No. 62/690,790, filed on Jun. 27, 2018.

(51) Int. Cl.
| C12N 15/11 | (2006.01) |
|---|---|
| A61K 31/7125 | (2006.01) |
| A61K 47/02 | (2006.01) |
| A61K 47/46 | (2006.01) |
| A61P 25/16 | (2006.01) |
| C12N 15/113 | (2010.01) |

(52) U.S. Cl.
CPC ...... *C12N 15/1137* (2013.01); *A61K 31/7125* (2013.01); *A61K 47/02* (2013.01); *A61K 47/46* (2013.01); *A61P 25/16* (2018.01); *C12N 2310/11* (2013.01); *C12N 2310/315* (2013.01); *C12N 2310/321* (2013.01); *C12N 2310/3341* (2013.01); *C12N 2310/341* (2013.01); *C12N 2310/346* (2013.01); *C12N 2310/3525* (2013.01)

(58) Field of Classification Search
None
See application file for complete search history.

(56) References Cited

U.S. PATENT DOCUMENTS

| 3,687,808 A | 8/1972 | Merigan et al. |
|---|---|---|
| 4,415,732 A | 11/1983 | Caruthers et al. |
| 4,469,863 A | 9/1984 | Ts'o et al. |
| 4,476,301 A | 10/1984 | Imbach et al. |
| 4,500,707 A | 2/1985 | Caruthers et al. |
| 4,725,677 A | 2/1988 | Koster et al. |
| 4,845,205 A | 7/1989 | Huynh Dinh et al. |
| 4,973,679 A | 11/1990 | Caruthers et al. |
| 4,981,957 A | 1/1991 | Lebleu et al. |
| 5,013,830 A | 5/1991 | Ohutsuka et al. |
| 5,023,243 A | 6/1991 | Tullis |
| 5,034,506 A | 7/1991 | Summerton et al. |
| 5,118,800 A | 6/1992 | Smith et al. |
| 5,130,302 A | 7/1992 | Spielvogel et al. |
| 5,132,418 A | 7/1992 | Caruthers et al. |
| 5,134,066 A | 7/1992 | Rogers et al. |
| RE34,036 E | 8/1992 | McGeehan |
| 5,149,797 A | 9/1992 | Pederson et al. |
| 5,166,315 A | 11/1992 | Summerton et al. |
| 5,175,273 A | 12/1992 | Bischofberger et al. |
| 5,177,196 A | 1/1993 | Meyer, Jr. et al. |
| 5,177,198 A | 1/1993 | Spielvogel et al. |
| 5,188,897 A | 2/1993 | Suhadolnik et al. |
| 5,194,599 A | 3/1993 | Froehler et al. |
| 5,214,134 A | 5/1993 | Weis et al. |
| 5,216,141 A | 6/1993 | Benner |
| 5,220,007 A | 6/1993 | Pederson et al. |
| 5,223,618 A | 6/1993 | Cook et al. |
| 5,235,033 A | 8/1993 | Summerton et al. |
| 5,256,775 A | 10/1993 | Froehler |
| 5,264,423 A | 11/1993 | Cohen et al. |
| 5,264,562 A | 11/1993 | Matteucci |
| 5,264,564 A | 11/1993 | Matteucci |
| 5,185,444 A | 12/1993 | Summerton et al. |
| 5,276,019 A | 1/1994 | Cohen et al. |
| 5,286,717 A | 2/1994 | Cohen et al. |
| 5,319,080 A | 6/1994 | Leumann |
| 5,321,131 A | 6/1994 | Agrawal et al. |

(Continued)

FOREIGN PATENT DOCUMENTS

| WO | WO 2004/094636 | 11/2004 |
|---|---|---|
| WO | WO 2006/006948 | 1/2006 |

(Continued)

OTHER PUBLICATIONS

Alegre-Abarrategui et al., LRRK2 regulates autophagic activity and localizes to specific membrane microdomains in a novel human genomic reporter cellular model: Hum Mol Genet (2009) 18(21): 4022-4034.

(Continued)

Primary Examiner — Ekaterina Poliakova-Georgantas

(74) Attorney, Agent, or Firm — McNeill PLLC

(57) ABSTRACT

Provided are compounds, methods, and pharmaceutical compositions for reducing the amount or activity of LRRK2 RNA in a cell or animal, and in certain instances reducing the amount of LRRK2 protein in a cell or animal. Such compounds, methods, and pharmaceutical compositions are useful to ameliorate at least one symptom or hallmark of a neurodegenerative disease. Such symptoms and hallmarks include ataxia, neuropathy, and aggregate formation. Such neurodegenerative diseases include Parkinson's disease.

25 Claims, No Drawings

Specification includes a Sequence Listing.

(56) References Cited

U.S. PATENT DOCUMENTS

| | | |
|---|---|---|
| 5,359,044 A | 10/1994 | Cook et al. |
| 5,366,878 A | 11/1994 | Pederson et al. |
| 5,367,066 A | 11/1994 | Urdea et al. |
| 5,378,825 A | 1/1995 | Cook et al. |
| 5,386,023 A | 1/1995 | Sanghvi et al. |
| 5,393,878 A | 2/1995 | Leumann |
| 5,399,676 A | 3/1995 | Froehler |
| 5,403,711 A | 4/1995 | Walder et al. |
| 5,405,938 A | 4/1995 | Sumerton et al. |
| 5,405,939 A | 4/1995 | Suhadolnik et al. |
| 5,432,272 A | 7/1995 | Benner |
| 5,434,257 A | 7/1995 | Matteucci |
| 5,446,137 A | 8/1995 | Maag et al. |
| 5,453,496 A | 9/1995 | Caruthers et al. |
| 5,455,233 A | 10/1995 | Spielvogel et al. |
| 5,457,187 A | 10/1995 | Gmelner et al. |
| 5,457,191 A | 10/1995 | Cook et al. |
| 5,459,255 A | 10/1995 | Cook et al. |
| 5,466,677 A | 11/1995 | Baxter et al. |
| 5,466,786 A | 11/1995 | Burh et al. |
| 5,470,967 A | 11/1995 | Huie et al. |
| 5,476,925 A | 12/1995 | Letsinger et al. |
| 5,484,908 A | 1/1996 | Froehler et al. |
| 5,489,677 A | 2/1996 | Sanghvi et al. |
| 5,491,133 A | 2/1996 | Walder et al. |
| 5,502,177 A | 3/1996 | Matteucci et al. |
| 5,508,270 A | 4/1996 | Baxter et al. |
| 5,514,785 A | 5/1996 | Van Ness et al. |
| 5,519,126 A | 5/1996 | Hecht |
| 5,519,134 A | 5/1996 | Acevedo et al. |
| 5,525,711 A | 6/1996 | Hawkins et al. |
| 5,527,899 A | 6/1996 | Froehler |
| 5,536,821 A | 7/1996 | Agrawal et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,552,540 A | 9/1996 | Haralambidis |
| 5,561,225 A | 10/1996 | Maddry et al. |
| 5,563,253 A | 10/1996 | Agrawal et al. |
| 5,565,350 A | 10/1996 | Kmiec |
| 5,565,555 A | 10/1996 | Froehler et al. |
| 5,567,811 A | 10/1996 | Mistura et al. |
| 5,571,799 A | 11/1996 | Tkachuk et al. |
| 5,576,427 A | 11/1996 | Cook et al. |
| 5,587,361 A | 12/1996 | Cook et al. |
| 5,587,469 A | 12/1996 | Cook et al. |
| 5,587,470 A | 12/1996 | Cook et al. |
| 5,591,722 A | 1/1997 | Montgomery et al. |
| 5,594,121 A | 1/1997 | Froehler et al. |
| 5,596,086 A | 1/1997 | Matteucci |
| 5,596,091 A | 1/1997 | Switzer |
| 5,597,909 A | 1/1997 | Urdea et al. |
| 5,602,240 A | 2/1997 | De Mesmaeker et al. |
| 5,608,046 A | 3/1997 | Cook et al. |
| 5,610,289 A | 3/1997 | Cook et al. |
| 5,610,300 A | 3/1997 | Altmann et al. |
| 5,614,617 A | 3/1997 | Cook et al. |
| 5,618,704 A | 4/1997 | Sanghvi et al. |
| 5,623,065 A | 4/1997 | Cook et al. |
| 5,623,070 A | 4/1997 | Cook et al. |
| 5,625,050 A | 4/1997 | Beaton et al. |
| 5,627,053 A | 5/1997 | Usman et al. |
| 5,633,360 A | 5/1997 | Bishofberger et al. |
| 5,639,873 A | 6/1997 | Barascut et al. |
| 5,645,985 A | 7/1997 | Froehler et al. |
| 5,646,265 A | 7/1997 | McGee |
| 5,646,269 A | 7/1997 | Matteucci |
| 5,652,355 A | 7/1997 | Metelev et al. |
| 5,652,356 A | 7/1997 | Agrawal |
| 5,663,312 A | 9/1997 | Chaturvedula |
| 5,670,633 A | 9/1997 | Cook et al. |
| 5,672,697 A | 9/1997 | Buhr et al. |
| 5,677,437 A | 10/1997 | Teng et al. |
| 5,677,439 A | 10/1997 | Weis et al. |
| 5,681,941 A | 10/1997 | Cook et al. |
| 5,698,685 A | 12/1997 | Summerton et al. |
| 5,700,920 A | 12/1997 | Altmann et al. |
| 5,700,922 A | 12/1997 | Cook |
| 5,721,218 A | 2/1998 | Froehler |
| 5,750,692 A | 5/1998 | Cook et al. |
| 5,763,588 A | 6/1998 | Matteucci et al. |
| 5,792,608 A | 8/1998 | Swaminathan et al. |
| 5,792,847 A | 8/1998 | Burh et al. |
| 5,801,154 A | 9/1998 | Baracchini et al. |
| 5,808,027 A | 9/1998 | Cook et al. |
| 5,830,653 A | 11/1998 | Froehler et al. |
| 5,859,221 A | 1/1999 | Cook et al. |
| 5,948,903 A | 9/1999 | Cook et al. |
| 5,994,517 A | 11/1999 | Ts'o |
| 6,005,087 A | 12/1999 | Cook et al. |
| 6,005,096 A | 12/1999 | Matteucci et al. |
| 6,166,199 A | 12/2000 | Cook et al. |
| 6,300,319 B1 | 10/2001 | Manoharan |
| 6,426,220 B1 | 7/2002 | Bennett et al. |
| 6,525,191 B1 | 2/2003 | Ramasamy |
| 6,531,584 B1 | 3/2003 | Cook et al. |
| 6,582,908 B2 | 6/2003 | Fodor et al. |
| 6,600,032 B1 | 7/2003 | Manoharan et al. |
| 6,660,720 B2 | 12/2003 | Manoharan |
| 6,770,748 B2 | 8/2004 | Imanishi et al. |
| 7,015,315 B1 | 3/2006 | Cook et al. |
| 7,053,207 B2 | 5/2006 | Wengel et al. |
| 7,101,993 B1 | 9/2006 | Cook et al. |
| 7,262,177 B2 | 8/2007 | Ts'o et al. |
| 7,399,845 B2 | 7/2008 | Seth et al. |
| 7,427,672 B2 | 9/2008 | Imanishi et al. |
| 7,491,805 B2 | 2/2009 | Vargeese et al. |
| 7,547,684 B2 | 6/2009 | Seth et al. |
| 7,569,686 B1 | 8/2009 | Bhat et al. |
| 7,666,854 B2 | 2/2010 | Seth et al. |
| 7,696,345 B2 | 4/2010 | Allerson et al. |
| 7,723,509 B2 | 5/2010 | Manoharan et al. |
| 7,741,457 B2 | 6/2010 | Swayze et al. |
| 7,750,131 B2 | 7/2010 | Seth et al. |
| 7,875,733 B2 | 1/2011 | Bhat et al. |
| 7,939,677 B2 | 5/2011 | Bhat et al. |
| 8,022,193 B2 | 9/2011 | Swayze et al. |
| 8,029,986 B2 | 10/2011 | Meitinger et al. |
| 8,030,467 B2 | 10/2011 | Seth et al. |
| 8,080,644 B2 | 12/2011 | Wengel et al. |
| 8,088,746 B2 | 1/2012 | Seth et al. |
| 8,088,904 B2 | 1/2012 | Swayze et al. |
| 8,106,022 B2 | 1/2012 | Manoharan et al. |
| 8,124,745 B2 | 2/2012 | Allerson et al. |
| 8,153,365 B2 | 4/2012 | Wengel et al. |
| 8,187,811 B2 | 5/2012 | Ericksson et al. |
| 8,268,980 B2 | 9/2012 | Seth et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,440,803 B2 | 5/2013 | Swayze et al. |
| 8,501,805 B2 | 8/2013 | Seth et al. |
| 8,530,640 B2 | 9/2013 | Seth et al. |
| 8,546,556 B2 | 10/2013 | Seth et al. |
| RE44,779 E | 2/2014 | Imanishi et al. |
| 8,669,048 B2 | 3/2014 | Reijo Pera et al. |
| 8,828,956 B2 | 9/2014 | Manoharan et al. |
| 9,005,906 B2 | 4/2015 | Swayze et al. |
| 9,012,421 B2 | 4/2015 | Migawa et al. |
| 9,127,276 B2 | 8/2015 | Prakash et al. |
| 9,290,760 B2 | 3/2016 | Rajeev et al. |
| 9,840,710 B2 | 12/2017 | Hastings et al. |
| 10,907,160 B2 | 2/2021 | Zhao et al. |
| 11,332,746 B1 | 5/2022 | Freier et al. |
| 11,873,495 B2 | 1/2024 | Cole et al. |
| 2001/0053519 A1 | 12/2001 | Fodor et al. |
| 2003/0158403 A1 | 8/2003 | Manoharan et al. |
| 2003/0175906 A1 | 9/2003 | Manoharan et al. |
| 2003/0228597 A1 | 12/2003 | Cowsert et al. |
| 2004/0171570 A1 | 9/2004 | Allerson et al. |
| 2005/0130923 A1 | 6/2005 | Bhat et al. |
| 2006/0148740 A1 | 7/2006 | Platenburg |
| 2007/0031844 A1 | 2/2007 | Khvorova et al. |
| 2008/0039618 A1 | 2/2008 | Allerson et al. |

(56) References Cited

U.S. PATENT DOCUMENTS

| | | |
|---|---|---|
| 2010/0190837 A1 | 7/2010 | Migawa et al. |
| 2010/0197762 A1 | 8/2010 | Swayze et al. |
| 2012/0052487 A9 | 3/2012 | Khvorova et al. |
| 2012/0135941 A1 | 5/2012 | Collard et al. |
| 2013/0130378 A1 | 5/2013 | Manoharan et al. |
| 2014/0107330 A1 | 4/2014 | Freier et al. |
| 2014/0128322 A1 | 5/2014 | Chen et al. |
| 2015/0018540 A1 | 1/2015 | Prakash et al. |
| 2015/0184153 A1 | 7/2015 | Freier et al. |
| 2015/0191727 A1 | 7/2015 | Migawa et al. |
| 2015/0267195 A1 | 9/2015 | Seth et al. |
| 2015/0275212 A1 | 10/2015 | Albaek et al. |
| 2017/0137826 A1 | 5/2017 | Hastings et al. |
| 2018/0179594 A1 | 6/2018 | Schule |
| 2018/0362988 A1 | 12/2018 | Zhao et al. |
| 2021/0340546 A1 | 11/2021 | Zhao et al. |
| 2023/0114930 A1 | 4/2023 | Cole et al. |

FOREIGN PATENT DOCUMENTS

| | | |
|---|---|---|
| WO | WO 2006/045392 | 5/2006 |
| WO | WO 2007/124096 | 11/2007 |
| WO | WO 2007/124751 | 11/2007 |
| WO | WO 2008/091799 | 7/2008 |
| WO | WO 2009/099991 | 8/2009 |
| WO | WO 2011/022606 | 2/2011 |
| WO | WO 2011/114106 | 9/2011 |
| WO | WO 2012/149438 | 11/2012 |
| WO | WO 2013/173635 | 11/2013 |
| WO | WO 2015/153800 | 10/2015 |
| WO | WO 2016/097212 | 6/2016 |
| WO | WO 2016/105516 | 6/2016 |
| WO | WO 2017/012576 | 1/2017 |
| WO | WO 2012/131365 | 3/2017 |
| WO | WO 2017/087282 | 5/2017 |
| WO | WO 2017/120365 | 7/2017 |
| WO | WO 2019/118325 | 6/2019 |
| WO | WO 2020/006267 | 1/2020 |

OTHER PUBLICATIONS

Atashrazm et al. "LRRK2 Inhibitors and Their Potential in the Treatment of Parkinson's Disease: Current Perspectives" Clin Pharmacol (2016) 177-189.

Bieri et al., "LRRK2 modifies α-syn pathology and spread in mouse models and human neurons" Gitler Lab (2019) 1-41.

Branch et al., "A good antisense molecule is hard to find," TIBS (1998) 23:45-50.

Chan et al., "Rac1 protein rescues neurite retraction caused by G2019S leucine-rich repeat kinase 2 (LRRK2)." J Biol Chem (2011) 286(18):16104-9.

Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.

Cho et al., "Leucine-rich repeat kinase 2 regulates Sec16A at ER exit sites to allow ER-Golgi export" EMBO J (2014) 33: 2314-2331.

Cole et al., "Antisense Oligonucleotide Therapeutics for the Treatment of Neurodegenerative Diseases" Presentation for Genetic Epidemiology of Parkinson's Disease (GEO-PD) (Sep. 12, 2014).

Crooke et al., "Basic Principles of Antisense Therapeutics" Antisense Research and Application (1998) Chapter 1:1-50.

Crooke, ST., et al., "Antisense Drug Technology" Second Edition, CRC Press (2008) Chapters 1-28.

Daher et al., "Abrogation of α-synuclein-mediated dopaminergic neurodegeneration in LRRK2-deficient rats" PNAS (2014) 111: 9289-9294.

Daher et al., "Leucine-rich Repeat Kinase 2 (LRRK2) Pharmacological Inhibition Abates α-synuclein Gene-induced Neurodegeneration" J Biol Chem (2015) 290: 19433-19444.

Daher et al., "Neurodegenerative phenotypes in an A53T α-synuclein transgenic mouse model are independent of LRRK2" Hum Mol Genet (2012) 21: 2420-2431.

Egli, et al., "Synthesis, improved antisense activity and structural rationale for the divergent RNA affinities of 3'-fluoro hexitol nucleic acid (FHNA and Ara-FHNA) modified oligonucleotides." J Am Chem (2011) 133(41):16642-16649.

Genbank Acc. No. NM_198578.3.

Genbank Acc. No. NT_029419.11.

Gautschi et al., "Activity of a novel bcl-2/bcl-xL bispecific antisense oligonucleotide against tumors of diverse histologic origins" J. Natl. Cancer Inst. (2001) 93:463-471.

Guerreiro et al., "LRRK2 interactions with α-synuclein in Parkingson's disease brains and in cell models" J Mol Med (2013) 91: 513-522.

Henderson et al., "LRRK2 activity does not dramatically alter α-synuclein pathology in primary neurons" Acta Neuropathologica Comm (2018) 6: 1-11.

Herzig et al., "LRRK2 protein levels are determined by kinase function and are crucial for kidney and lung homeostasis in mice" Human Mol Gen (2011) 20(21): 4209-4223.

Herzig et al., "High LRRK2 Levels Fail to Induce or Exacerbate Neuronal Alpha-Synucleinopathy in Mouse Brain" PLoS One (2012) 7(5): 1-14.

Hinkle et al., "LRRK2 knockout mice have an intact dopaminergic system but display alterations in exploratory and motor co-ordination behaviors" Mol Neurodegener (2012) 7: 1-17.

Hirst "LRRK2 ASO: Path to the Clinic" Abstract for Michael J Fox LRRK2 Summit (Mar. 25-26, 2019).

International Search Report for PCT/US17/12374 dated Mar. 23, 2017.

International Search Report for PCT/US19/39558 dated Nov. 14, 2019.

Lin et al., "Leucine-rich repeat kinase 2 regulates the progression of neuropathology induced by Parkinson's-disease-related mutant alpha-synuclein" Neuron (2009) 64: 807-827.

Lloret et al, "Validation of LRRK2 as a Drug Target for Treatment of Parkinson's Disease Using Antisense Technology" Michael J. Fox Foundation Funded Grant Interim Progress Report, (2009) retreived from the internet on Sep. 11, 2018 (https://www.michaeljfox.org/foundation/grant-detail.php?grant_id=542).

Luk et al., "Pathological α-synuclein transmission initiates Parkinson-like neurodegeneration in nontransgenic mice" Science (2012) 338(6109): 949-953.

Maher et al., "Comparative hybrid arrest by tandem antisense oligodeoxyribonucleotides or oligodeoxyribonucleoside methylpbosphonates in a cell-free system" Nucl. Acid. Res. (1998) 16(8):3341-3358.

New England Biolabs 1998/99 Catalog (cover page and pp. 121 and 284).

Nichols et al., "Substrate specificity and inhibitors of LRRK2, a protein kinase mutated in Parkinson's disease." Biochem J. (2009) 424(1):47-60.

O'Hara et al., "LRRK2 and α-Synuclein: Distinct or Synergistic Players in Parkinson's Disease?" Frontiers in Neuroscience (2020) 14: 1-18.

Reynolds et al., "Rational siRNA design for RNA interference" Nature Biotechnology (2004) 22(3):326-330.

Sanghvi et al., "Heterocyclic Base Modifications in Nucleic Acids and Their Applications in Antisense Oligonucleotides" Antisense Research and Applications (1993) pp. 273-288.

Seth et al., "Short Antisense Oligonucleotides with Novel 2'-4' Conformationaly Restricted Nucleoside Analogues Show Improved Potency Without Increased Toxicity in Animals." J Med Chem (2009) 52:10-13.

Sheng et al., "Deletion of the WD40 Domain of LRRK2 in Zebrafish Causes Parkinsonism-Like Loss of Neurons and Locomotive Defect" PloS Genetics (2010) 6(4):e1000914.

Sibley et al., "Identification of allele-specific RNAi effectors targeting genetic forms of Parkinson's disease" PLoS One (2011) 6(10): e26194.

Sibley et al., "Silencing of Parkinson's disease-associated genes with artificial mirtron mimics of miR-1224" Nucleic Acids Res. (2012) 40(19): 9863-9875.

(56) References Cited

OTHER PUBLICATIONS

Swayze "This Is Your Brain on Antisense Oligonucleotides: Distribution, Activity and Application to the Treatment of Severe Neurodegenerative Disease" Abstract for 253rd Meeting of the American Chemical Society (Apr. 2-6, 2017).

Swayze "This Is Your Brain on Antisense Oligonucleotides: Distribution, Activity and Application to the Treatment of Severe Neurodegenerative Disease" Presentation for 253rd Meeting of the American Chemical Society (Apr. 2, 2017).

Tatarnikov et al., "Neurotransmission in LRRK2 and VPS35 mutant mice—rescued by acute LRRK2 knock-down" Presentation for Society for Neuroscience Annual Meeting (Sep. 15, 2016).

Tong et al., "Loss of leucine-rich repeat kinase 2 causes age-dependent bi-phasic alterations of the autophagy pathway" Mol Neurodegener (2012) 7: 1-16.

Tran et al., "Antisense oligonucleotides to LRRK2 ameliorate alpha-synuclein pathology and behavioral deficit induced by pre-formed alpha-synuclein fibrils." Abstract from Society for Neuroscience meeting Nov. 15, 2016, retreived from the internet Aug. 15, 2018 http://www.abstractsonline.com/pp8/index.html#!/4071/presentation/14652/.

Volpicelli-Daley et al, "LRRK2 Expression Augments α-Synuclein Sequestration into Inclusions in Neurons" J Neuroscience (2016) 36(28):7415-7427.

Volpicelli-Daley et al., "LRRK2 facilitates formation of alph-synuclein inclusions." abstract from Society for Neuroscience meeting, Nov. 15, 2016, retreived online Aug. 21, 2018 http://www.abstractsonline.com/pp8/index.html#!/4071/presentation/14651.

Volta et al., "Chronic and acute LRRK2 silencing has no long-term behavioral effects, whereas wild-type and mutant LRRK2 overexpression induce motor and cognitive deficits and altered regulation of dopamine release." Parkinsonism anRelat Disord (2015) 21(10):1156-63.

Woolf et al., "Specificity of antisense oligonucleotides in vivo" PNAS (1992) 89: 7305-7309.

Ynigo-Mojado et al., "Efficient allele-specific targeting of LRRK2 R1441 mutations mediated by RNAi" PLoS One (2011) 6: e21352.

Zhao et al., "Antisense oligonucleotides to LRRK2 ameliorate alpha-synuclein pathology and behavioral deficit induced by pre-formed alpha-sunuclein fibrils" Abstract from American Acadamy of Neurology meeting, Oct. 16, 2012, retreived from the internet Aug. 15, 2018: http://www.abstractsonline.com/pp8/#!/4046/presentation/8588.

Zhao et al., "Antisense oligonucleotides to LRRK2 ameliorate alpha-synuclein pathology and behavioral deficit induced by pre-formed alpha-synuclein fibrils" Presentation for Society for Neuroscience Annual Meeting (Sep. 15, 2016).

Zhao "Inhibitors of Leucine-rich Repeat Kinase 2 (LRRK2): Progress & Promise for the Treatment of Parkinson's Disease" Presentation for World CNS Summit (Feb. 20, 2017).

Zhao et al., "Antisense Oligonucleotides to LRRK2 Ameliorate alpha-Synuclein Pathology and Behavioral Deficit Induced by Pre-Formed alpha-Synuclein Fibrils." Annals of Neurology (2017) 82(21):S56-S57.

Zhao et al., "Antisense Oligonucleotides to LRRK2 Ameliorate alpha-Synuclein Pathology and Behavioral Deficit Induced by Pre-Formed alpha-Synuclein Fibrils." 13th International Conference on Alzheimer's and Parkinson's diseases, abstract presented Apr. 1, 2017.

Zhao et al., "LRRK2 Antisense Oligonucleotides Ameliorate α-Synuclein Inclusion Formation in a Parkinson's Disease Mouse Model" Mol Ther Nucleic Acids (2017) 8:508-519.

Zhao et al., "LRRK2 Antisense Oligonucleotides Ameliorate α-Synuclein Inclusion Formation in a Parkinson's Disease Mouse Model" Abstract for 142nd Annual Meeting of the American Neurological Association (Oct. 15-17, 2017).

Zhao et al., "LRRK2 Antisense Oligonucleotides Ameliorate α-Synuclein Inclusion Formation in a Parkinson's Disease Mouse Model" Poster for 142nd Annual Meeting of the American Neurological Association (Oct. 15-17, 2017).

COMPOUNDS AND METHODS FOR REDUCING LRRK2 EXPRESSION

SEQUENCE LISTING

The present application is being filed along with a Sequence Listing in electronic format. The Sequence Listing is provided as a file entitled BIOL0324SEQ.xml, created on Nov. 15, 2023, which is 5.13 MB in size. The information in the electronic format of the sequence listing is incorporated herein by reference in its entirety.

FIELD

Provided are compounds, methods, and pharmaceutical compositions for reducing the amount or activity of leucine-rich repeat kinase 2 (LRRK2) RNA in a cell or animal, and in certain instances reducing the amount of LRRK2 protein in a cell or animal. Such compounds, methods, and pharmaceutical compositions are useful to ameliorate at least one symptom or hallmark of a neurodegenerative disease. Such symptoms and hallmarks include ataxia, neuropathy, and aggregate formation. Such neurodegenerative diseases include Parkinson's disease.

BACKGROUND

The LRRK2 gene encodes a protein with an armadillo repeat (ARM) region, an ankyrin repeat (ANK) region, a leucine-rich repeat (LRR) domain, a kinase domain, a RAS domain, a GTPase domain, and a WD40 domain. The protein is present largely in the cytoplasm but also associates with the mitochondrial outer membrane. One segment of the LRRK2 protein is enriched with leucine and may be involved in signal transduction and cytoskeleton assembly. Other parts of the LRRK2 protein are also thought to be involved in protein-protein interactions. Additional studies indicate that LRRK2 protein has an enzyme function known as kinase activity, including phosphorylation and GTPase activity. LRRK2 is active in the brain and other tissues throughout the body.

Genomewide association studies have found an association between LRRK2 and Parkinson's disease. Indeed, LRRK2 is the greatest known genetic contributor to Parkinson's disease. Nonetheless, Parkinson's disease has not been considered to be a genetic disease. The majority of Parkinson's disease cases are idiopathic. Approximately 10 percent of Parkinson's disease cases have been linked to a genetic cause. Mutations in the LRRK2 gene are the most common cause of Parkinson's disease in this relatively small group, representing one to two percent of total Parkinson's disease cases.

Currently there is a lack of acceptable options for treating neurodegenerative diseases such as Parkinson's disease, including non-LRRK2 mediated Parkinson's disease. It is therefore an object herein to provide compounds, methods, and pharmaceutical compositions for the treatment of such diseases.

SUMMARY OF THE INVENTION

Provided herein are compounds, methods and pharmaceutical compositions for reducing the amount or activity of LRRK2 RNA, and in certain embodiments reducing the amount of LRRK2 protein in a cell or animal. In certain embodiments, the animal has a neurodegenerative disease. In certain embodiments, the animal has Parkinson's disease. In certain embodiments, compounds useful for reducing expression of LRRK2 RNA are oligomeric compounds. In certain embodiments, compounds useful for reducing expression of LRRK2 RNA are modified oligonucleotides.

Also provided are methods useful for ameliorating at least one symptom or hallmark of a neurodegenerative disease. In certain embodiments, the neurodegenerative disease is Parkinson's disease. In certain embodiments, the Parkinson's disease is either LRRK2 mediated Parkinson's disease or non-LRRK2 mediated Parkinson's disease. In certain embodiments, the symptom or hallmark includes ataxia, neuropathy, and aggregate formation. In certain embodiments, amelioration of these symptoms results in improved motor function, reduced neuropathy, and reduction in number of aggregates.

DETAILED DESCRIPTION OF THE INVENTION

It is to be understood that both the foregoing general description and the following detailed description are exemplary and explanatory only and are not restrictive. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated-by-reference for the portions of the document discussed herein, as well as in their entirety.

Definitions

Unless specific definitions are provided, the nomenclature used in connection with, and the procedures and techniques of, analytical chemistry, synthetic organic chemistry, and medicinal and pharmaceutical chemistry described herein are those well known and commonly used in the art. Where permitted, all patents, applications, published applications and other publications and other data referred to throughout in the disclosure are incorporated by reference herein in their entirety.

Unless otherwise indicated, the following terms have the following meanings:

Definitions

As used herein, "2'-deoxynucleoside" means a nucleoside comprising a 2'-H(H) deoxyribosyl sugar moiety, as found in naturally occurring deoxyribonucleic acids (DNA). In certain embodiments, a 2'-deoxynucleoside may comprise a modified nucleobase or may comprise an RNA nucleobase (uracil).

As used herein, "2'-substituted nucleoside" means a nucleoside comprising a 2'-substituted sugar moiety. As used herein, "2'-substituted" in reference to a sugar moiety means a sugar moiety comprising at least one 2'-substituent group other than H or OH.

As used herein, "5-methyl cytosine" means a cytosine modified with a methyl group attached to the 5 position. A 5-methyl cytosine is a modified nucleobase.

As used herein, "administering" means providing a pharmaceutical agent to an animal.

As used herein, "animal" means a human or non-human animal.

As used herein, "antisense activity" means any detectable and/or measurable change attributable to the hybridization of an antisense compound to its target nucleic acid. In certain embodiments, antisense activity is a decrease in the amount or expression of a target nucleic acid or protein encoded by such target nucleic acid compared to target nucleic acid levels or target protein levels in the absence of the antisense compound.

As used herein, "antisense compound" means an oligomeric compound capable of achieving at least one antisense activity.

As used herein, "ameliorate" in reference to a treatment means improvement in at least one symptom relative to the same symptom in the absence of the treatment. In certain embodiments, amelioration is the reduction in the severity or frequency of a symptom or the delayed onset or slowing of progression in the severity or frequency of a symptom. In certain embodiments, the symptom or hallmark is ataxia, neuropathy, and aggregate formation. In certain embodiments, amelioration of these symptoms results in improved motor function, reduced neuropathy, and reduction in number of aggregates.

As used herein, "bicyclic nucleoside" or "BNA" means a nucleoside comprising a bicyclic sugar moiety.

As used herein, "bicyclic sugar" or "bicyclic sugar moiety" means a modified sugar moiety comprising two rings, wherein the second ring is formed via a bridge connecting two of the atoms in the first ring thereby forming a bicyclic structure. In certain embodiments, the first ring of the bicyclic sugar moiety is a furanosyl moiety. In certain embodiments, the bicyclic sugar moiety does not comprise a furanosyl moiety.

As used herein, "cleavable moiety" means a bond or group of atoms that is cleaved under physiological conditions, for example, inside a cell, an animal, or a human.

As used herein, "complementary" in reference to an oligonucleotide means that at least 70% of the nucleobases of the oligonucleotide or one or more regions thereof and the nucleobases of another nucleic acid or one or more regions thereof are capable of hydrogen bonding with one another when the nucleobase sequence of the oligonucleotide and the other nucleic acid are aligned in opposing directions. Complementary nucleobases means nucleobases that are capable of forming hydrogen bonds with one another. Complementary nucleobase pairs include adenine (A) and thymine (T), adenine (A) and uracil (U), cytosine (C) and guanine (G), 5-methyl cytosine (mC) and guanine (G). Complementary oligonucleotides and/or nucleic acids need not have nucleobase complementarity at each nucleoside. Rather, some mismatches are tolerated. As used herein, "fully complementary" or "100% complementary" in reference to oligonucleotides means that oligonucleotides are complementary to another oligonucleotide or nucleic acid at each nucleoside of the oligonucleotide.

As used herein, "conjugate group" means a group of atoms that is directly attached to an oligonucleotide. Conjugate groups include a conjugate moiety and a conjugate linker that attaches the conjugate moiety to the oligonucleotide.

As used herein, "conjugate linker" means a single bond or a group of atoms comprising at least one bond that connects a conjugate moiety to an oligonucleotide.

As used herein, "conjugate moiety" means a group of atoms that is attached to an oligonucleotide via a conjugate linker.

As used herein, "contiguous" in the context of an oligonucleotide refers to nucleosides, nucleobases, sugar moieties, or internucleoside linkages that are immediately adjacent to each other. For example, "contiguous nucleobases" means nucleobases that are immediately adjacent to each other in a sequence.

As used herein, "constrained ethyl" or "cEt" or "cEt modified sugar" means a β-D ribosyl bicyclic sugar moiety wherein the second ring of the bicyclic sugar is formed via a bridge connecting the 4'-carbon and the 2'-carbon of the β-D ribosyl sugar moiety, wherein the bridge has the formula 4'-CH(CH$_3$)—O-2', and wherein the methyl group of the bridge is in the S configuration.

As used herein, "cEt nucleoside" means a nucleoside comprising cEt modified sugar.

As used herein, "chirally enriched population" means a plurality of molecules of identical molecular formula, wherein the number or percentage of molecules within the population that contain a particular stereochemical configuration at a particular chiral center is greater than the number or percentage of molecules expected to contain the same particular stereochemical configuration at the same particular chiral center within the population if the particular chiral center were stereorandom. Chirally enriched populations of molecules having multiple chiral centers within each molecule may contain one or more stereorandom chiral centers. In certain embodiments, the molecules are modified oligonucleotides. In certain embodiments, the molecules are compounds comprising modified oligonucleotides.

As used herein, "gapmer" means a modified oligonucleotide comprising an internal region having a plurality of nucleosides that support RNase H cleavage positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings." Unless otherwise indicated, "gapmer" refers to a sugar motif. Unless otherwise indicated, the sugar moieties of the nucleosides of the gap of a gapmer are unmodified 2'-deoxyribosyl. Thus, the term "MOE gapmer" indicates a gapmer having a sugar motif of 2'-MOE nucleosides in both wings and a gap of 2'-deoxynucleosides. Unless otherwise indicated, a MOE gapmer may comprise one or more modified internucleoside linkages and/or modified nucleobases and such modifications do not necessarily follow the gapmer pattern of the sugar modifications.

As used herein, "hotspot region" is a range of nucleobases on a target nucleic acid amenable to oligomeric compound-mediated reduction of the amount or activity of the target nucleic acid.

As used herein, "hybridization" means the pairing or annealing of complementary oligonucleotides and/or nucleic acids. While not limited to a particular mechanism, the most common mechanism of hybridization involves hydrogen bonding, which may be Watson-Crick, Hoogsteen or reversed Hoogsteen hydrogen bonding, between complementary nucleobases.

As used herein, the term "internucleoside linkage" is the covalent linkage between adjacent nucleosides in an oligonucleotide. As used herein "modified internucleoside linkage" means any internucleoside linkage other than a phosphodiester internucleoside linkage. "Phosphorothioate internucleoside linkage" is a modified internucleoside linkage in which one of the non-bridging oxygen atoms of a phosphodiester internucleoside linkage is replaced with a sulfur atom.

As used herein, "linker-nucleoside" means a nucleoside that links, either directly or indirectly, an oligonucleotide to a conjugate moiety. Linker-nucleosides are located within the conjugate linker of an oligomeric compound. Linker-nucleosides are not considered part of the oligonucleotide portion of an oligomeric compound even if they are contiguous with the oligonucleotide.

As used herein, "non-bicyclic modified sugar moiety" means a modified sugar moiety that comprises a modification, such as a substituent, that does not form a bridge between two atoms of the sugar to form a second ring.

As used herein, "mismatch" or "non-complementary" means a nucleobase of a first oligonucleotide that is not complementary with the corresponding nucleobase of a second oligonucleotide or target nucleic acid when the first and second oligonucleotide are aligned.

As used herein, "MOE" means methoxyethyl. "2'-MOE" or "2'-MOE modified sugar" means a 2'-OCH$_2$CH$_2$OCH$_3$ group in place of the 2'-OH group of a ribosyl sugar moiety. As used herein, "2'-MOE nucleoside" means a nucleoside comprising a 2'-MOE modified sugar.

As used herein, "motif" means the pattern of unmodified and/or modified sugar moieties, nucleobases, and/or internucleoside linkages, in an oligonucleotide.

As used herein, "RNA" means an RNA transcript that encodes a protein and includes pre-mRNA and mature mRNA unless otherwise specified.

As used herein, "neurodegenerative disease" means a condition marked by progressive loss of function or structure, including loss of motor function and death of neurons. In certain embodiments, the neurodegenerative disease is Parkinson's disease. In certain embodiments, the Parkinson's disease may be LRRK2 mediated Parkinson's disease or non-LRRK2 mediated Parkinson's disease.

"Non-LRRK2 mediated Parkinson's Disease" is a diagnosis of Parkinson's disease not associated with a causative LRRK2 genetic mutation. Causative LRRK2 genetic mutations include G2019S, R1441C, R1441G, I2020T, and Y1699C. Diagnosis of Parkinson's disease may be accomplished by any method including evaluating an individual's medical history, observation of signs and symptoms, and standard clinical tests or assessments. Genetic testing for a mutation associated with LRRK2, such as G2019S, R1441C, R1441G, I2020T, and Y1699C, may reveal whether an individual has non-LRRK2 mediated Parkinson's disease. An individual having a diagnosis of Parkinson's disease, but without a causative LRRK2 mutation, has non-LRRK2 mediated Parkinson's disease. "Identifying an animal having non-LRRK2 mediated Parkinson's Disease" means identifying an animal having been diagnosed with Parkinson's Disease or predisposed to develop Parkinson's Disease without a causative LRRK2 mutation.

As used herein, "nucleobase" means an unmodified nucleobase or a modified nucleobase. As used herein an "unmodified nucleobase" is adenine (A), thymine (T), cytosine (C), uracil (U), or guanine (G). As used herein, a "modified nucleobase" is a group of atoms other than unmodified A, T, C, U, or G capable of pairing with at least one unmodified nucleobase. A "5-methyl cytosine" is a modified nucleobase. A universal base is a modified nucleobase that can pair with any one of the five unmodified nucleobases. As used herein, "nucleobase sequence" means the order of contiguous nucleobases in a nucleic acid or oligonucleotide independent of any sugar or internucleoside linkage modification.

As used herein, "nucleoside" means a compound comprising a nucleobase and a sugar moiety. The nucleobase and sugar moiety are each, independently, unmodified or modified. As used herein, "modified nucleoside" means a nucleoside comprising a modified nucleobase and/or a modified sugar moiety. Modified nucleosides include abasic nucleosides, which lack a nucleobase. "Linked nucleosides" are nucleosides that are connected in a contiguous sequence (i.e., no additional nucleosides are presented between those that are linked).

As used herein, "oligomeric compound" means an oligonucleotide and optionally one or more additional features, such as a conjugate group or terminal group. An oligomeric compound may be paired with a second oligomeric compound that is complementary to the first oligomeric compound or may be unpaired. A "singled-stranded oligomeric compound" is an unpaired oligomeric compound. The term "oligomeric duplex" means a duplex formed by two oligomeric compounds having complementary nucleobase sequences. Each oligomeric compound of an oligomeric duplex may be referred to as a "duplexed oligomeric compound."

As used herein, "oligonucleotide" means a strand of linked nucleosides connected via internucleoside linkages, wherein each nucleoside and internucleoside linkage may be modified or unmodified. Unless otherwise indicated, oligonucleotides consist of 8-50 linked nucleosides. As used herein, "modified oligonucleotide" means an oligonucleotide, wherein at least one nucleoside or internucleoside linkage is modified. As used herein, "unmodified oligonucleotide" means an oligonucleotide that does not comprise any nucleoside modifications or internucleoside modifications.

As used herein, "pharmaceutically acceptable carrier or diluent" means any substance suitable for use in administering to an animal. Certain such carriers enable pharmaceutical compositions to be formulated as, for example, tablets, pills, dragees, capsules, liquids, gels, syrups, slurries, suspension and lozenges for the oral ingestion by a subject. In certain embodiments, a pharmaceutically acceptable carrier or diluent is sterile water, sterile saline, sterile buffer solution or sterile artificial cerebrospinal fluid.

As used herein "pharmaceutically acceptable salts" means physiologically and pharmaceutically acceptable salts of compounds. Pharmaceutically acceptable salts retain the desired biological activity of the parent compound and do not impart undesired toxicological effects thereto.

As used herein "pharmaceutical composition" means a mixture of substances suitable for administering to a subject. For example, a pharmaceutical composition may comprise an oligomeric compound and a sterile aqueous solution. In certain embodiments, a pharmaceutical composition shows activity in free uptake assay in certain cell lines.

As used herein "prodrug" means a therapeutic agent in a form outside the body that is converted to a different form within an animal or cells thereof. Typically conversion of a prodrug within the animal is facilitated by the action of an enzymes (e.g., endogenous or viral enzyme) or chemicals present in cells or tissues and/or by physiologic conditions.

As used herein, "reducing or inhibiting the amount or activity" refers to a reduction or blockade of the transcriptional expression or activity relative to the transcripexpression or activity in an untreated or control sample and does not necessarily indicate a total elimination of transcriptional expression or activity.

As used herein, "RNAi compound" means an antisense compound that acts, at least in part, through RISC or Ago2 to modulate a target nucleic acid and/or protein encoded by a target nucleic acid. RNAi compounds include, but are not limited to double-stranded siRNA, single-stranded RNA (ssRNA), and microRNA, including microRNA mimics. In certain embodiments, an RNAi compound modulates the amount, activity, and/or splicing of a target nucleic acid. The term RNAi compound excludes antisense compounds that act through RNase H.

As used herein, "self-complementary" in reference to an oligonucleotide means an oligonucleotide that at least partially hybridizes to itself.

As used herein, "siRNA" refers to a ribonucleic acid molecule having a duplex structure including two antiparallel and substantially complementary nucleic acid strands. The two strands forming the duplex structure may be different portions of one larger RNA molecule, or they may be separate RNA molecules. Where the two strands are part of one larger molecule, and therefore are connected by consecutive nucelobases between the 3'-end of one strand and the 5' end of the respective other strand forming the duplex structure, the connecting RNA chain is referred to as a "hairpin loop". The RNA strands may have the same or a different number of nucleotides.

As used herein, "standard cell assay" means the assay described in Example 4 and reasonable variations thereof.

As used herein, "standard in vivo assay" means the experiment described in Example 14 and reasonable variations thereof.

As used herein, "stereorandom chiral center" in the context of a population of molecules of identical molecular formula means a chiral center having a random stereochemical configuration. For example, in a population of molecules comprising a stereorandom chiral center, the number of molecules having the (S) configuration of the stereorandom chiral center may be but is not necessarily the same as the number of molecules having the (R) configuration of the stereorandom chiral center. The stereochemical configuration of a chiral center is considered random when it is the results of a synthetic method that is not designed to control the stereochemical configuration. In certain embodiments, a stereorandom chiral center is a stereorandom phosphorothioate internucleoside linkage.

As used herein, "sugar moiety" means an unmodified sugar moiety or a modified sugar moiety. As used herein, "unmodified sugar moiety" means a 2'-OH(H) ribosyl moiety, as found in RNA (an "unmodified RNA sugar moiety"), or a 2'-H(H) deoxyribosyl moiety, as found in DNA (an "unmodified DNA sugar moiety"). Unmodified sugar moieties have one hydrogen at each of the 1', 3', and 4' positions, an oxygen at the 3' position, and two hydrogens at the 5' position. As used herein, "modified sugar moiety" or "modified sugar" means a modified furanosyl sugar moiety or a sugar surrogate.

As used herein, "sugar surrogate" means a modified sugar moiety having other than a furanosyl moiety that can link a nucleobase to another group, such as an internucleoside linkage, conjugate group, or terminal group in an oligonucleotide. Modified nucleosides comprising sugar surrogates can be incorporated into one or more positions within an oligonucleotide and such oligonucleotides are capable of hybridizing to complementary oligomeric compounds or target nucleic acids.

As used herein, "target nucleic acid" and "target RNA" mean a nucleic acid that an antisense compound is designed to affect.

As used herein, "target region" means a portion of a target nucleic acid to which an oligomeric compound is designed to hybridize.

As used herein, "terminal group" means a chemical group or group of atoms that is covalently linked to a terminus of an oligonucleotide.

As used herein, "therapeutically effective amount" means an amount of a pharmaceutical agent that provides a therapeutic benefit to an animal. For example, a therapeutically effective amount improves a symptom of a disease.

CERTAIN EMBODIMENTS

The present disclosure provides the following non-limiting numbered embodiments:

Embodiment 1. An oligomeric compound comprising a modified oligonucleotide consisting of 12 to 50 linked nucleosides wherein the nucleobase sequence of the modified oligonucleotide is at least 90% complementary to an equal length portion of a LRRK2 nucleic acid, and wherein the modified oligonucleotide comprises at least one modification selected from a modified sugar, a sugar surrogate, and a modified internucleoside linkage.

Embodiment 2: An oligomeric compound comprising a modified oligonucleotide consisting of 12 to 50 linked nucleosides and having a nucleobase sequence comprising at least 12, at least 13, at least 14, at least 15, at least 16, at least 17, at least 18, at least 19, or at least 20 contiguous nucleobases of any of the nucleobase sequences of SEQ ID NOS: 30-3847.

Embodiment 3: An oligomeric compound comprising a modified oligonucleotide consisting of 12 to 50 linked nucleosides and having a nucleobase sequence comprising a portion of at least 8, at least 9, at least 10, at least 11, at least 12, at least 13, at least 14, at least 15, at least 16, at least 17, at least 18, at least 19, or at least 20 contiguous nucleobases, wherein the portion is complementary to:

an equal length portion of nucleobases 18,633-18,658 of SEQ ID NO: 2;

an equal length portion of nucleobases 21,721-21,755 of SEQ ID NO: 2;

an equal length portion of nucleobases 27,963-28,016 of SEQ ID NO: 2;

an equal length portion of nucleobases 35,415-35,446 of SEQ ID NO: 2;

an equal length portion of nucleobases 77,221-77,264 of SEQ ID NO: 2;

an equal length portion of nucleobases 81,581-81,612 and/or 87,838-87,869 of SEQ ID NO: 2;

an equal length portion of nucleobases 81,627-81,651 of SEQ ID NO: 2;

an equal length portion of nucleobases 82,058-82,081 of SEQ ID NO: 2;

an equal length portion of nucleobases 82,180-82,220 of SEQ ID NO: 2;

an equal length portion of nucleobases 82,500-82,525 of SEQ ID NO: 2;

an equal length portion of nucleobases 91,038-91,067 of SEQ ID NO: 2;

an equal length portion of nucleobases 92,148-92,173 of SEQ ID NO: 2;

am equal length portion of nucleobases 98,186-98,220 of SEQ ID NO: 2;

an equal length portion of nucleobases 98,218-98,242 of SEQ ID NO: 2;
an equal length portion of nucleobases 99,199-99,223 of SEQ ID NO: 2;
an equal length portion of nucleobases 119,903-119,936 of SEQ ID NO: 2; or
an equal length portion of nucleobases 4,062-4,086 of SEQ ID NO: 1.

Embodiment 4. The oligomeric compound of any of embodiments 1-3, wherein the modified oligonucleotide has a nucleobase sequence that is at least 80%, 85%, 90%, 95%, or 100% complementary to the nucleobase sequence of SEQ ID NO: 1 or SEQ ID NO: 2, when measured across the entire nucleobase sequence of the modified oligonucleotide.

Embodiment 5. The oligomeric compound of any of embodiments 1-4, wherein the modified oligonucleotide comprises at least one modified nucleoside.

Embodiment 6. The oligomeric compound of embodiment 5, wherein the modified oligonucleotide comprises at least one modified nucleoside comprising a modified sugar moiety.

Embodiment 7. The oligomeric compound of embodiment 6, wherein the modified oligonucleotide comprises at least one modified nucleoside comprising a bicyclic sugar moiety.

Embodiment 8. The oligomeric compound of embodiment 7, wherein the modified oligonucleotide comprises at least one modified nucleoside comprising a bicyclic sugar moiety having a 2'-4' bridge, wherein the 2'-4' bridge is selected from —O—CH$_2$—; and —O—CH(CH$_3$)—.

Embodiment 9. The oligomeric compound of any of embodiments 5-8, wherein the modified oligonucleotide comprises at least one modified nucleoside comprising a non-bicyclic modified sugar moiety.

Embodiment 10. The oligomeric compound of embodiment 9, wherein the modified oligonucleotide comprises at least one modified nucleoside comprising a non-bicyclic modified sugar moiety comprising a 2'-MOE modified sugar or 2'-OMe modified sugar.

Embodiment 11. The oligomeric compound of any of embodiments 5-10, wherein the modified oligonucleotide comprises at least one modified nucleoside comprising a sugar surrogate.

Embodiment 12. The oligomeric compound of embodiment 11, wherein the modified oligonucleotide comprises at least one modified nucleoside comprising a sugar surrogate selected from morpholino and PNA.

Embodiment 13. The oligomeric compound of any of embodiments 1-12, wherein the modified oligonucleotide has a sugar motif comprising:
a 5'-region consisting of 1-5 linked 5'-region nucleosides;
a central region consisting of 6-10 linked central region nucleosides; and
a 3'-region consisting of 1-5 linked 3'-region nucleosides;
wherein
each of the 5'-region nucleosides and each of the 3'-region nucleosides comprises a modified sugar moiety and each of the central region nucleosides comprises an unmodified 2'-deoxyribosyl sugar moiety.

Embodiment 14. The oligomeric compound of any of embodiments 1-13, wherein the modified oligonucleotide comprises at least one modified internucleoside linkage.

Embodiment 15. The oligomeric compound of embodiment 14, wherein each internucleoside linkage of the modified oligonucleotide is a modified internucleoside linkage.

Embodiment 16. The oligomeric compound of embodiment 14 or 15 wherein at least one internucleoside linkage is a phosphorothioate internucleoside linkage.

Embodiment 17. The oligomeric compound of embodiment 14 or 16 wherein the modified oligonucleotide comprises at least one phosphodiester internucleoside linkage.

Embodiment 18. The oligomeric compound of any of embodiments 14, 16, or 17, wherein each internucleoside linkage is either a phosphodiester internucleoside linkage or a phosphorothioate internucleoside linkage.

Embodiment 19. The oligomeric compound of any of embodiments 1-18, wherein the modified oligonucleotide comprises at least one modified nucleobase.

Embodiment 20. The oligomeric compound of embodiment 19, wherein the modified nucleobase is a 5-methyl cytosine.

Embodiment 21. The oligomeric compound of any of embodiments 1-20, wherein the modified oligonucleotide consists of 12-30, 12-22, 12-20, 14-20, 15-25, 16-20, 18-22 or 18-20 linked nucleosides.

Embodiment 22. The oligomeric compound of any of embodiments 1-21, wherein the modified oligonucleotide consists of 17 or 20 linked nucleosides.

Embodiment 23. The oligomeric compound of any of embodiments 1-22 consisting of the modified oligonucleotide.

Embodiment 24. The oligomeric compound of any of embodiments 1-22 comprising a conjugate group comprising a conjugate moiety and a conjugate linker.

Embodiment 25. The oligomeric compound of embodiment 24, wherein the conjugate group comprises a GalNAc cluster comprising 1-3 GalNAc ligands.

Embodiment 26. The oligomeric compound of embodiment 24 or 25, wherein the conjugate linker consists of a single bond.

Embodiment 27. The oligomeric compound of embodiment 25, wherein the conjugate linker is cleavable.

Embodiment 28. The oligomeric compound of embodiment 27, wherein the conjugate linker comprises 1-3 linker-nucleosides.

Embodiment 29. The oligomeric compound of any of embodiments 24-28, wherein the conjugate group is attached to the modified oligonucleotide at the 5'-end of the modified oligonucleotide.

Embodiment 30. The oligomeric compound of any of embodiments 24-28, wherein the conjugate group is attached to the modified oligonucleotide at the 3'-end of the modified oligonucleotide.

Embodiment 31. The oligomeric compound of any of embodiments 1-30 comprising a terminal group.

Embodiment 32. The oligomeric compound of any of embodiments 1-31 wherein the oligomeric compound is a singled-stranded oligomeric compound.

Embodiment 33. The oligomeric compound of any of embodiments 1-27 or 29-31, wherein the oligomeric compound does not comprise linker-nucleosides.

Embodiment 34. An oligomeric duplex comprising an oligomeric compound of any of embodiments 1-31 or 33.

Embodiment 35. An antisense compound comprising or consisting of an oligomeric compound of any of embodiments 1-33 or an oligomeric duplex of embodiment 34.

Embodiment 36. A pharmaceutical composition comprising an oligomeric compound of any of embodiments 1-33 or an oligomeric duplex of embodiment 34 and a pharmaceutically acceptable carrier or diluent.

Embodiment 37. A modified oligonucleotide according to the following formula:
(SEQ ID NO: 3849)
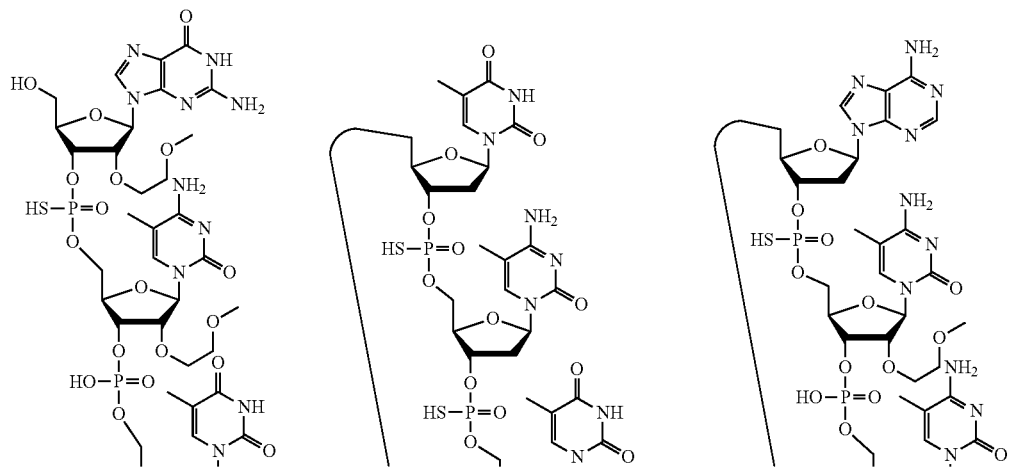
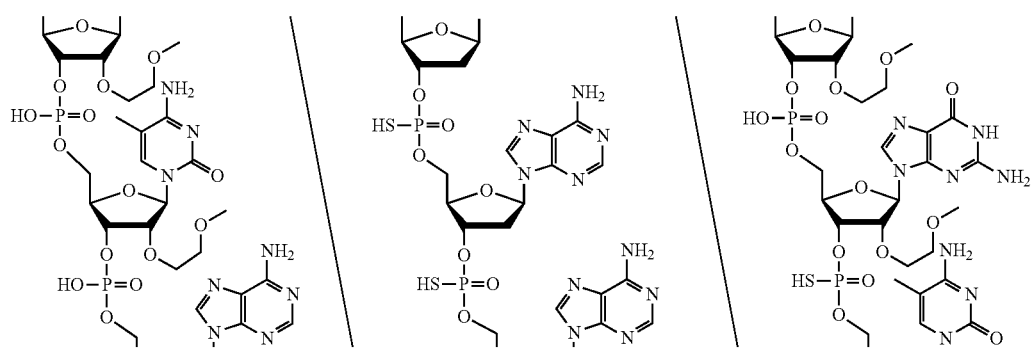
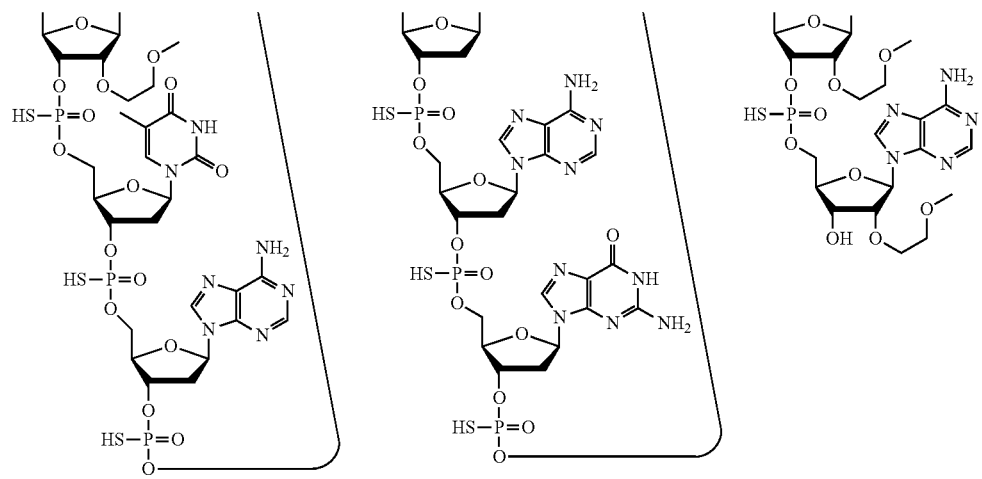
or a salt thereof.

Embodiment 38. A modified oligonucleotide according to the following formula:
(SEQ ID NO: 3850)
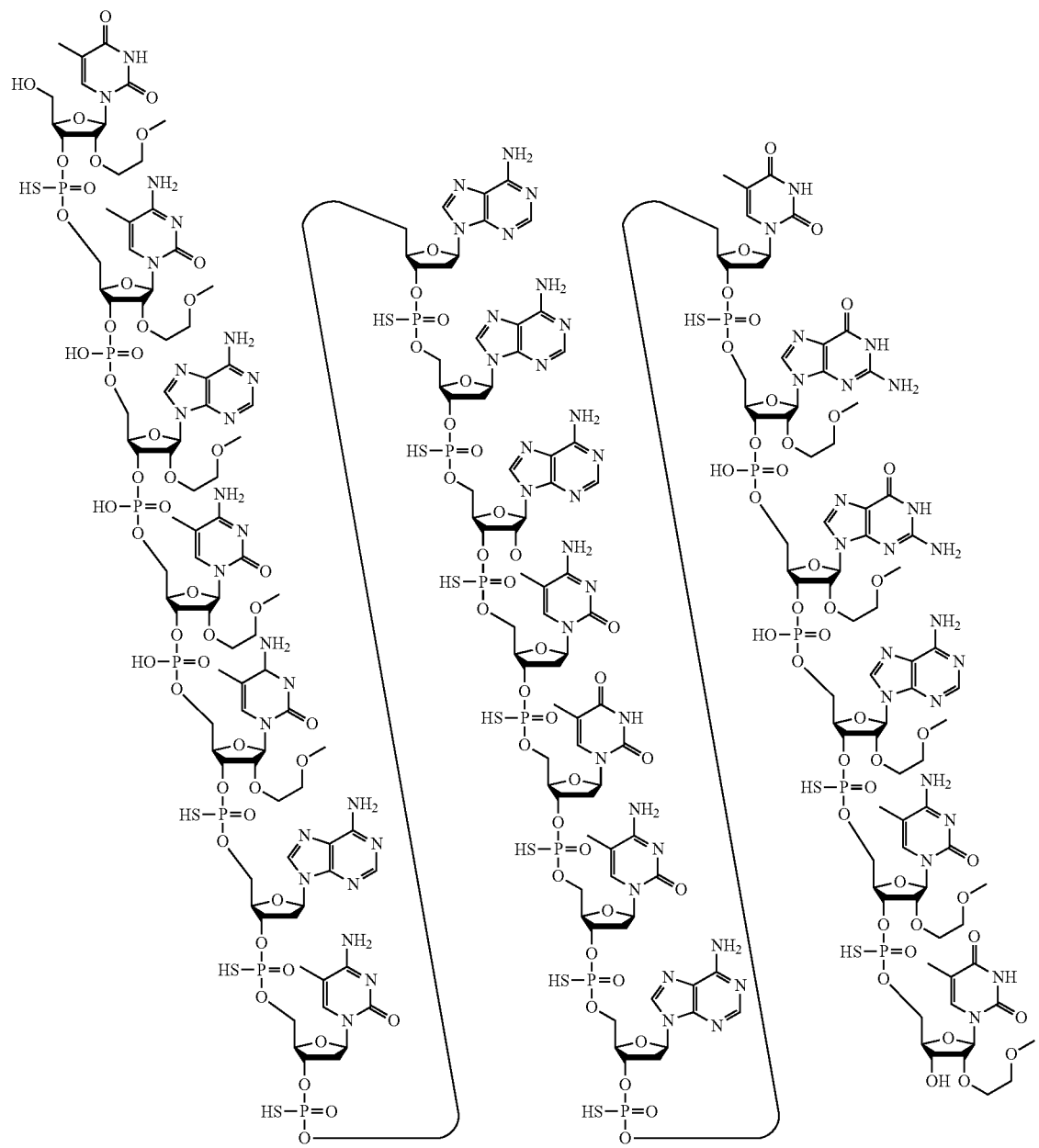
or a salt thereof.

Embodiment 39. A modified oligonucleotide according to the following formula:
(SEQ ID NO: 3851)
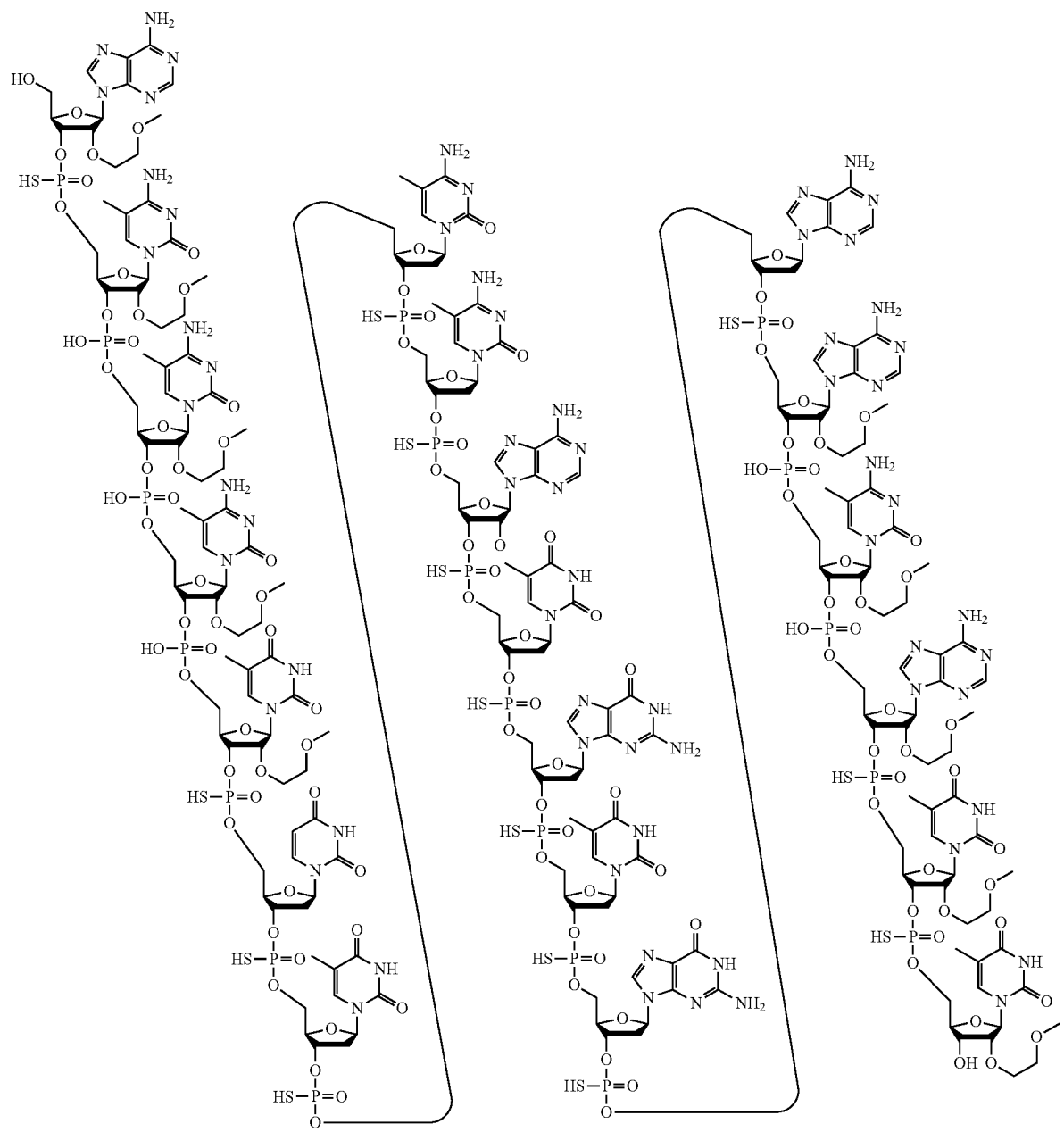
or a salt thereof.

Embodiment 40. A modified oligonucleotide according to the following formula:
(SEQ ID NO: 3852)
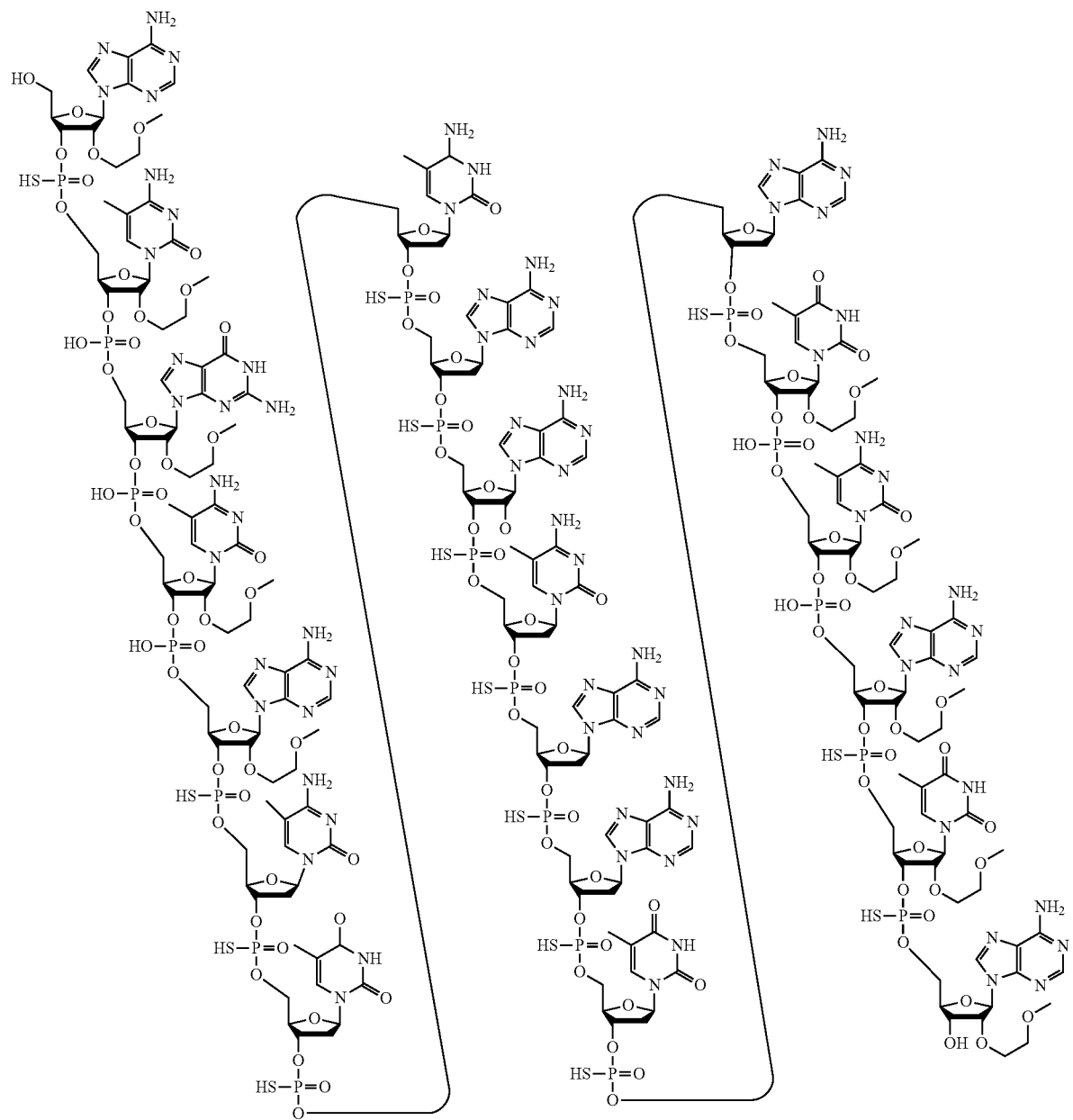
or a salt thereof.

Embodiment 41. A modified oligonucleotide according to the following formula:
(SEQ ID NO: 3853)
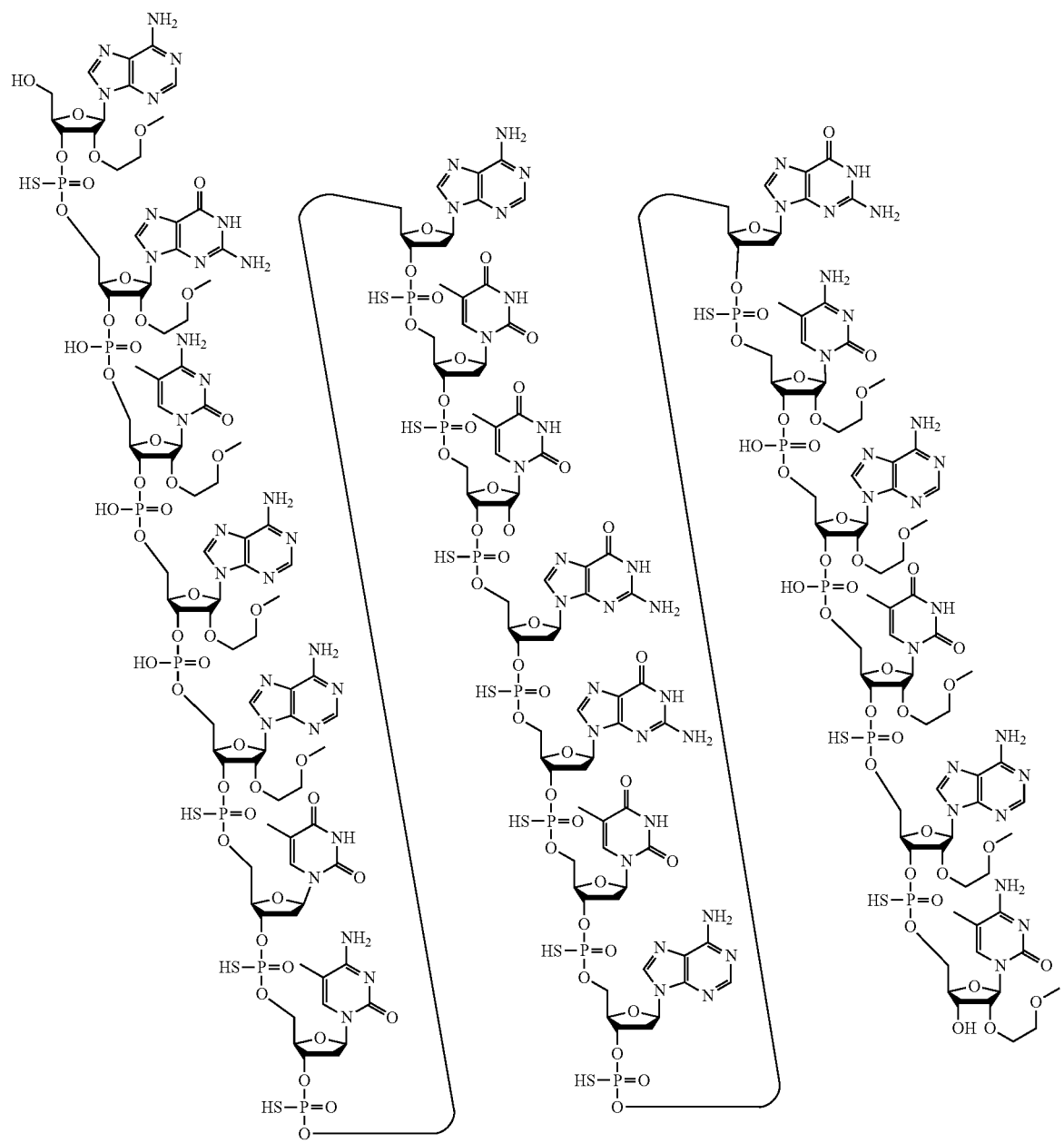
or a salt thereof.

Embodiment 42. A modified oligonucleotide according to the following formula:
(SEQ ID NO: 3854)
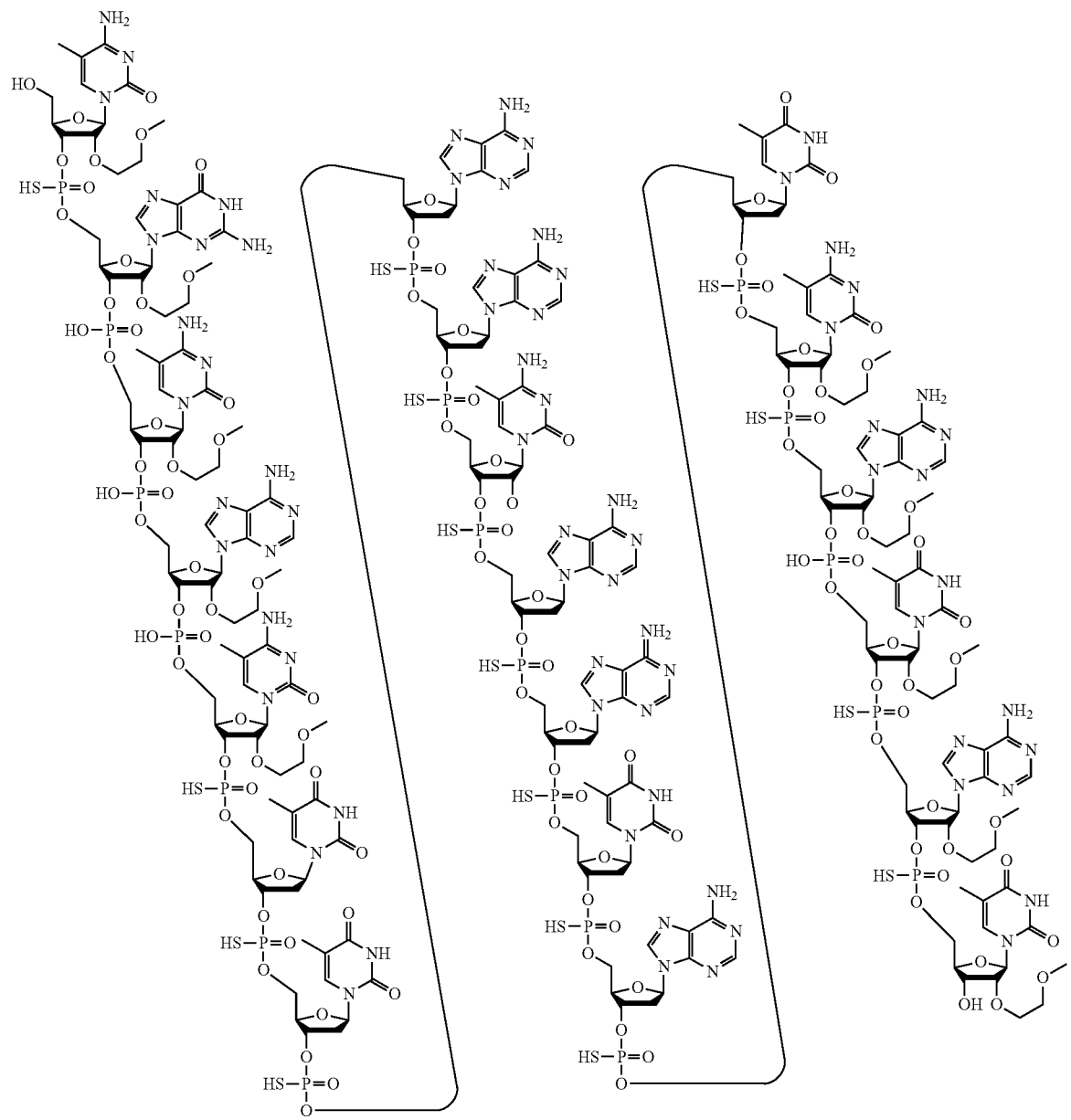
or a salt thereof.
Embodiment 43. The modified oligonucleotide of any of embodiments 37-42, which is a sodium salt of the formula.

Embodiment 44. A modified oligonucleotide according to the following formula:
(SEQ ID NO: 3849)
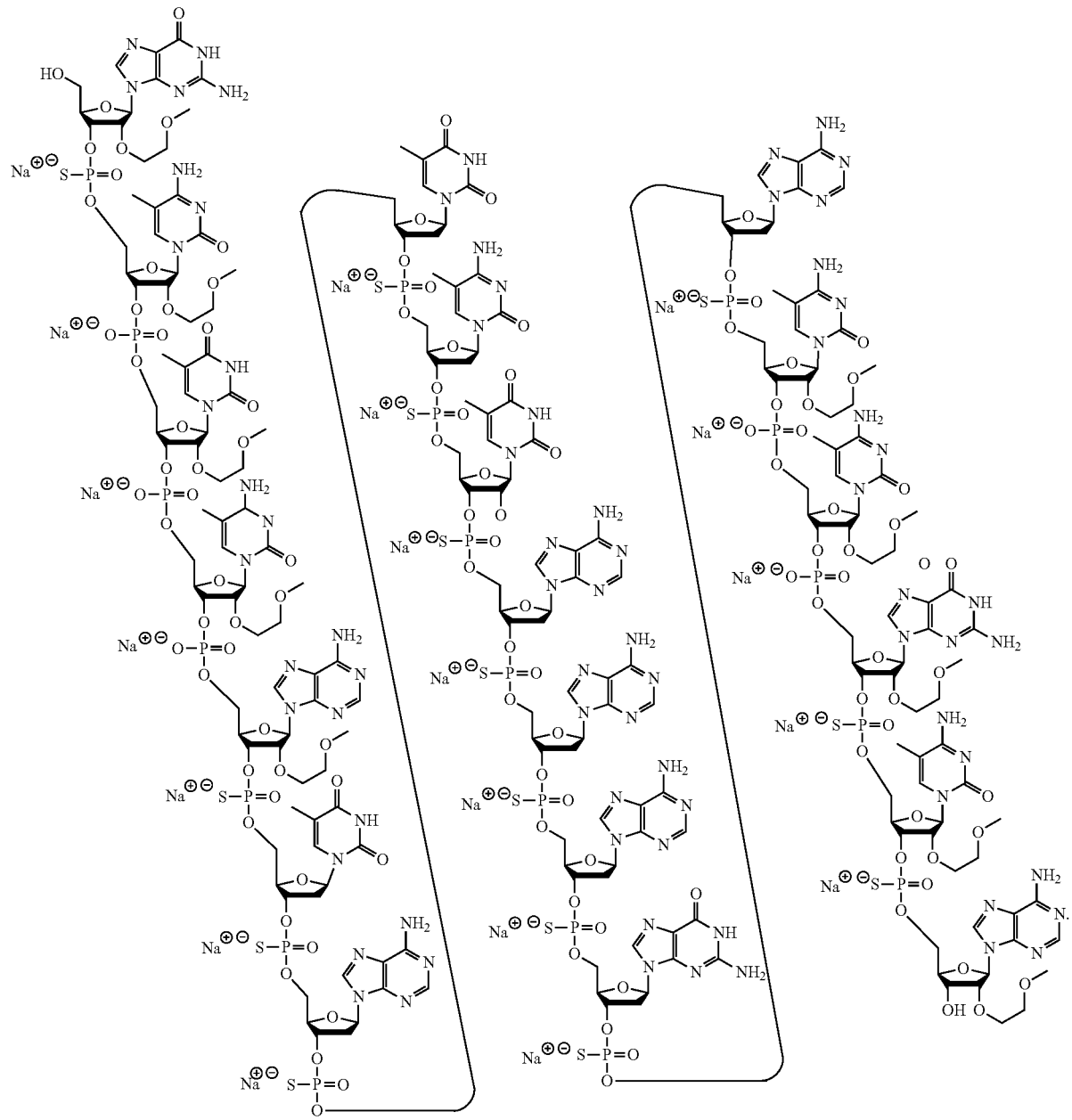

Embodiment 45. A modified oligonucleotide according to the following formula:
(SEQ ID NO: 3850)
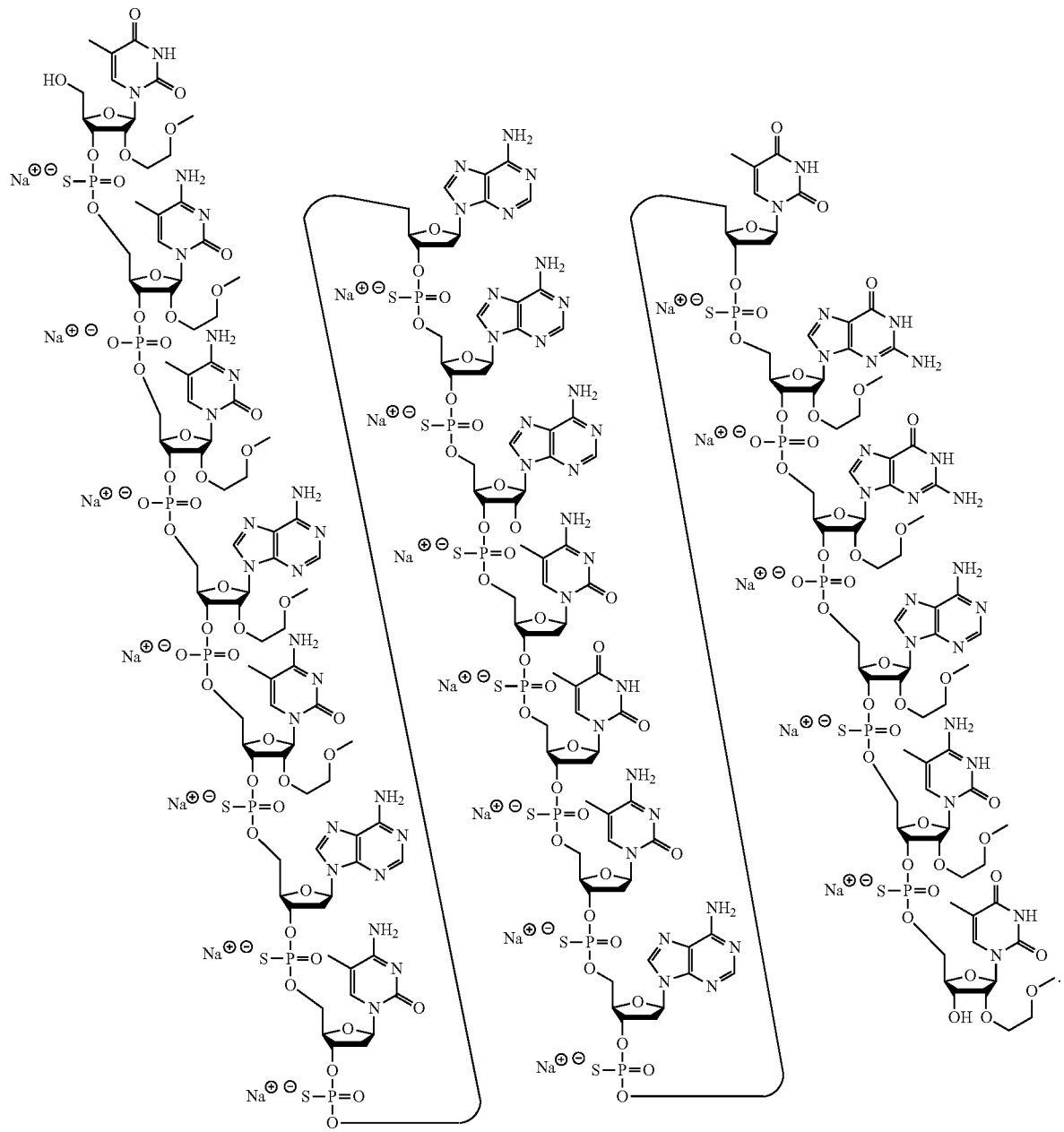

Embodiment 46. A modified oligonucleotide according to the following formula:
(SEQ ID NO: 3851)
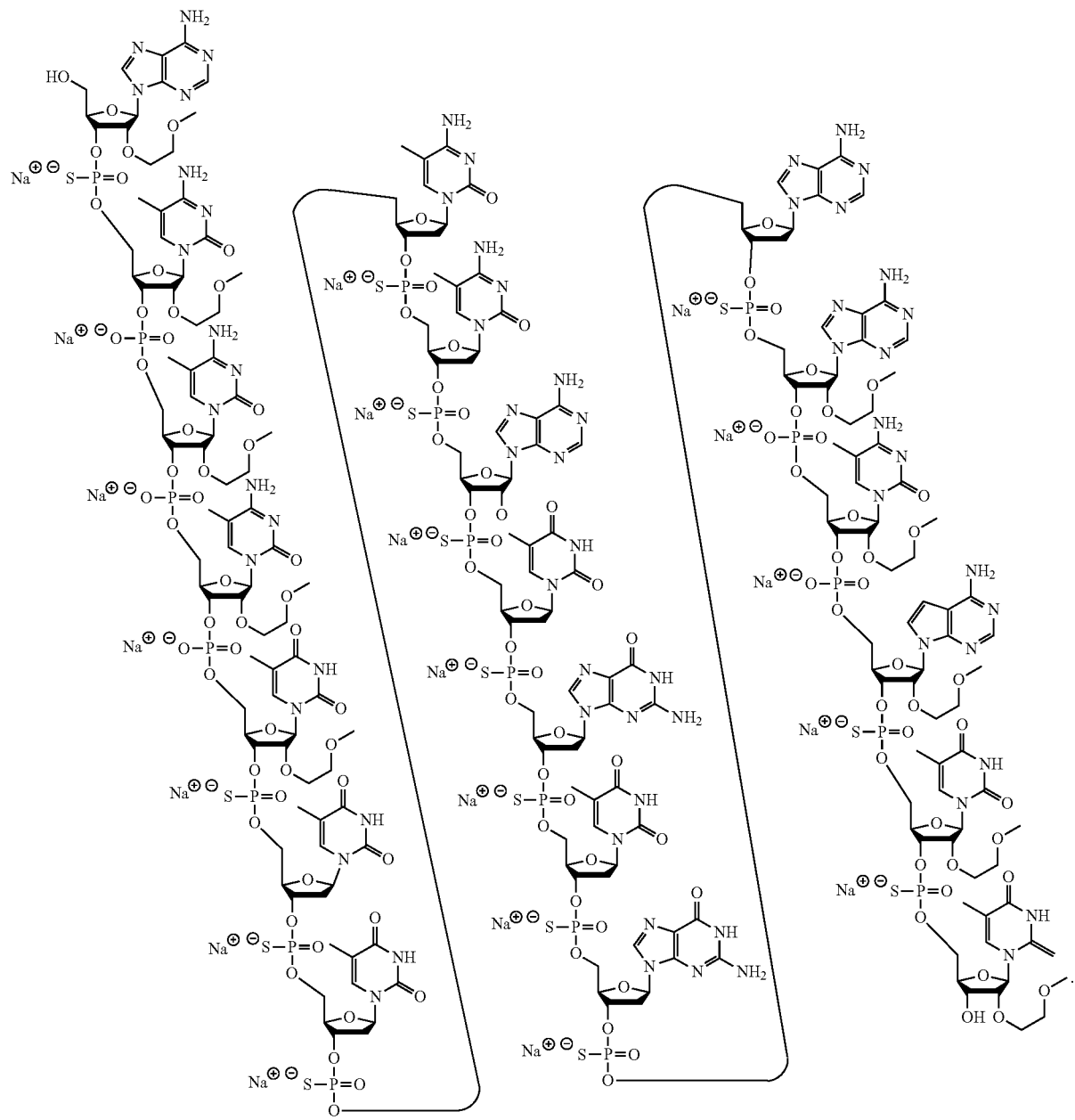

Embodiment 47. A modified oligonucleotide according to the following formula:
(SEQ ID NO: 3852)
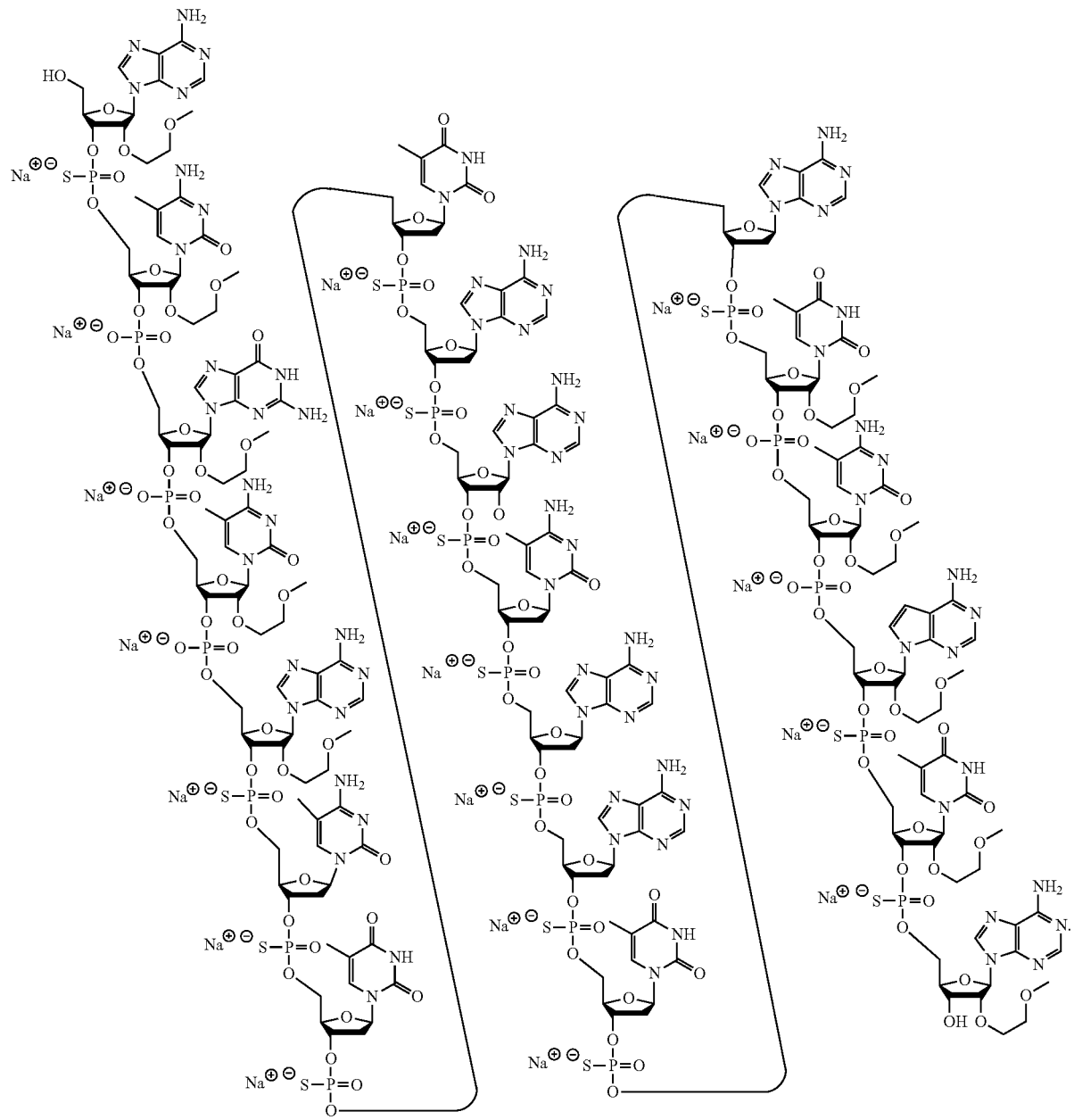

Embodiment 48. A modified oligonucleotide according to the following formula:
(SEQ ID NO: 3853)
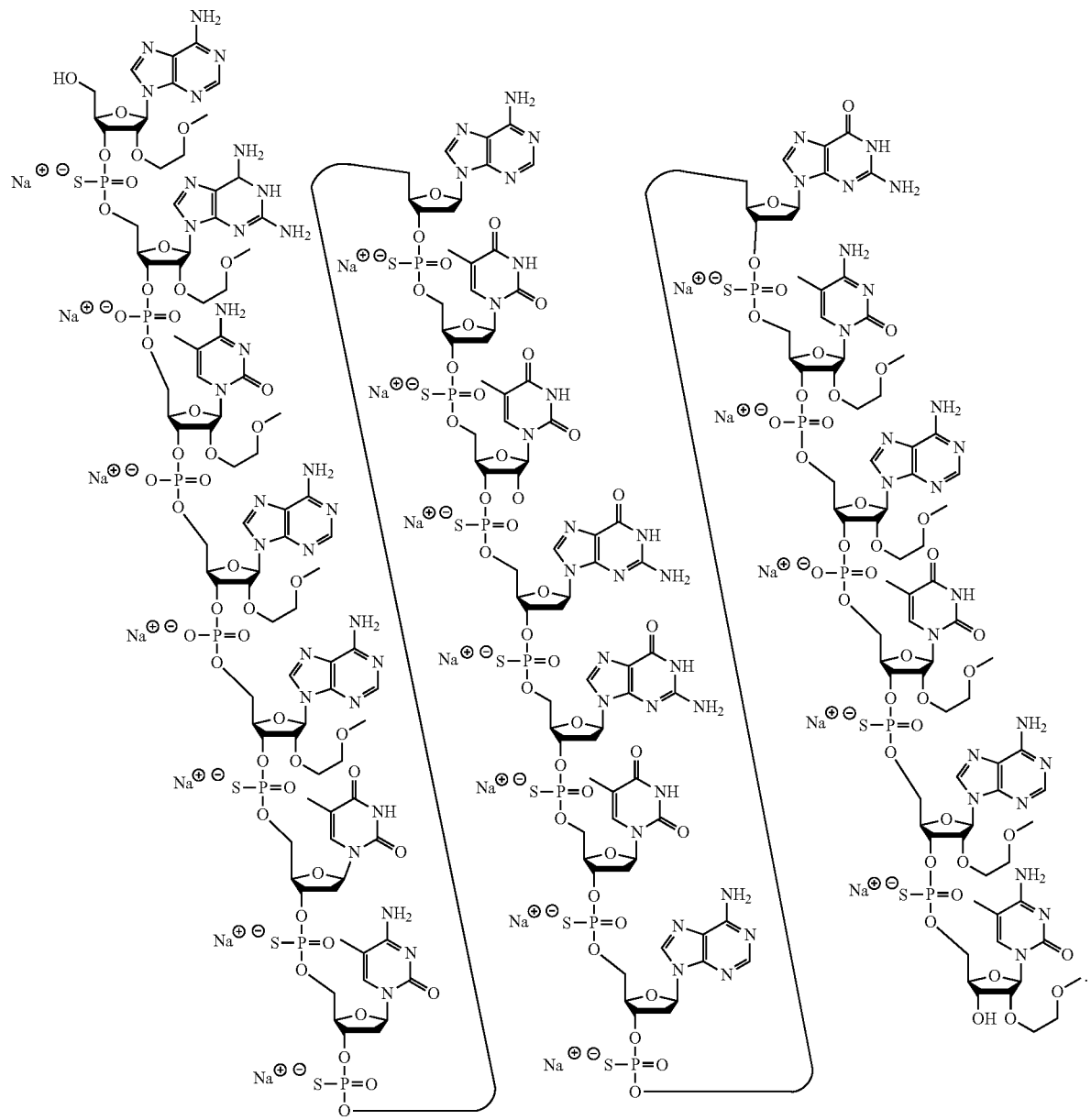

Embodiment 49. A modified oligonucleotide according to the following formula:

phosphorothioate internucleoside linkage having the (Rp) configuration.

(SEQ ID NO: 3854)

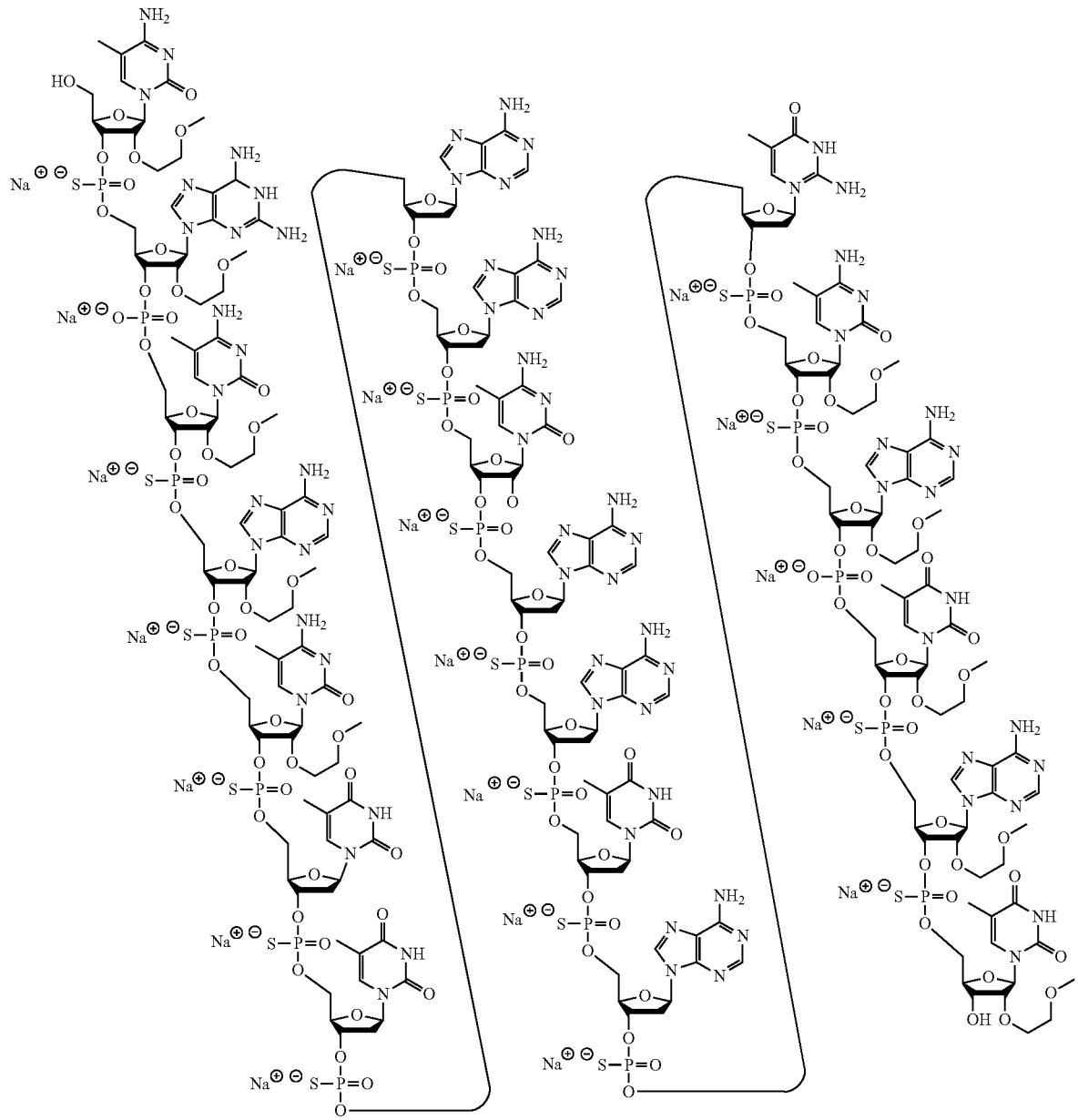

Embodiment 50. A chirally enriched population of the modified oligonucleotide of any of embodiments 37-49 wherein the population is enriched for modified oligonucleotides comprising at least one particular phosphorothioate internucleoside linkage having a particular stereochemical configuration.

Embodiment 51. The chirally enriched population of embodiment 50, wherein the population is enriched for a modified oligonucleotide comprising at least one particular phosphorothioate internucleoside linkage having the (Sp) configuration.

Embodiment 52. The chirally enriched population of embodiment 50 or 51, wherein the population is enriched for modified oligonucleotides having at least one particular Embodiment 53. The chirally enriched population of embodiment 50, wherein the population is enriched for modified oligonucleotides having a particular, independently selected stereochemical configuration at each phosphorothioate internucleoside linkage Embodiment 54. The chirally enriched population of embodiment 53, wherein the population is enriched for modified oligonucleotides having the (Sp) configuration at each phosphorothioate internucleoside linkage.

Embodiment 55. The chirally enriched population of embodiment 53, wherein the population is enriched for modified oligonucleotides having the (Rp) configuration at each phosphorothioate internucleoside linkage.

Embodiment 56. The chirally enriched population of embodiment 50 or embodiment 53 wherein the population is enriched for modified oligonucleotides having at least 3 contiguous phosphorothioate internucleoside linkages in the Sp-Sp-Rp configuration, in the 5' to 3' direction.

Embodiment 57. A population of modified oligonucleotides of any of embodiments 37-49, wherein all of the phosphorothioate internucleoside linkages of the modified oligonucleotide are stereorandom.

Embodiment 58. A pharmaceutical composition comprising the modified oligonucleotide of any of embodiments 37-49 and a pharmaceutically acceptable diluent or carrier.

Embodiment 59. The pharmaceutical composition of embodiment 58, wherein the pharmaceutically acceptable diluent is artificial cerebrospinal fluid.

Embodiment 60. The pharmaceutical composition of embodiment 59, wherein the pharmaceutical composition consists essentially of the modified oligonucleotide and artificial cerebrospinal fluid.

Embodiment 61. A method comprising administering to an animal a pharmaceutical composition of any of embodiments 36 or 58-60.

Embodiment 62. A method of treating a disease associated with LRRK2 comprising administering to an individual having or at risk for developing a disease associated with LRRK2 a therapeutically effective amount of a pharmaceutical composition according to any of embodiments 36 or 58-60; and thereby treating the disease associated with LRRK2.

Embodiment 63. The method of embodiment 62, wherein the disease associated with LRRK2 is a neurodegenerative disease.

Embodiment 64. The method of embodiment 63, wherein the neurodegenerative disease is Parkinson's disease.

Embodiment 65. The method of embodiment 64, wherein at least one symptom or hallmark of the neurodegenerative disease is ameliorated.

Embodiment 66. The method of embodiment 65, wherein the symptom or hallmark is any of ataxia, neuropathy, and aggregate formation.

Embodiment 67. An oligomeric compound comprising a modified oligonucleotide according to the following formula:

Ges mCeo Teo mCeo Aes Tds Ads Tds mCds Tds
Ads Ads Ads Gds Ads mCeo mCeo Ges mCes
Ae (SEQ ID NO: 3849); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 68. An oligomeric compound comprising a modified oligonucleotide according to the following formula:

Tes mCeo Aeo mCeo mCes Ads mCds Ads Ads Ads
mCds Tds mCds Ads Tds Geo Geo Aes mCes
Te (SEQ ID NO: 3850); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 69. An oligomeric compound comprising a modified oligonucleotide according to the following formula:

Aes mCeo mCeo mCeo Tes Tds Tds mCds mCds
Ads Tds Gds Tds Gds Ads Aeo mCeo Aes Tes
Te (SEQ ID NO: 3851); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 70. An oligomeric compound comprising a modified oligonucleotide according to the following formula:

Aes mCeo Geo mCeo Aes mCds Tds Tds Ads Ads
mCds Ads Ads Tds Ads Teo
mCeo Aes Tes Ae (SEQ ID NO: 3852); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 71. An oligomeric compound comprising a modified oligonucleotide according to the following formula:

Aes Geo mCeo Aeo Aes Tds mCds Ads Tds Tds
Gds Gds Tds Ads Gds
mCeo Aeo Tes Aes mCe (SEQ ID NO: 3853); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 72. An oligomeric compound comprising a modified oligonucleotide according to the following formula:

mCes Geo mCes Aes mCes Tds Tds Ads Ads mCds
Ads Ads Tds Ads Tds mCes
Aeo Tes Aes Te (SEQ ID NO: 3854); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Embodiment 73. The oligomeric compound of embodiment 3, wherein the modified oligonucleotide is an RNAi compound.

Embodiment 74. The oligomeric compound of embodiment 73, wherein the RNAi compound is an ssRNA or an siRNA.

I. Certain Oligonucleotides

In certain embodiments, provided herein are oligomeric compounds comprising oligonucleotides, which consist of linked nucleosides. Oligonucleotides may be unmodified oligonucleotides (RNA or DNA) or may be modified oligonucleotides. Modified oligonucleotides comprise at least one modification relative to unmodified RNA or DNA. That is, modified oligonucleotides comprise at least one modified nucleoside (comprising a modified sugar moiety and/or a modified nucleobase) and/or at least one modified internucleoside linkage.

A. Certain Modified Nucleosides

Modified nucleosides comprise a modified sugar moiety or a modified nucleobase or both a modified sugar moiety and a modified nucleobase.

1. Certain Sugar Moieties

In certain embodiments, modified sugar moieties are non-bicyclic modified sugar moieties. In certain embodiments, modified sugar moieties are bicyclic or tricyclic sugar moieties. In certain embodiments, modified sugar moieties are sugar surrogates. Such sugar surrogates may comprise one or more substitutions corresponding to those of other types of modified sugar moieties.

In certain embodiments, modified sugar moieties are non-bicyclic modified sugar moieties comprising a furanosyl ring with one or more substituent groups none of which bridges two atoms of the furanosyl ring to form a bicyclic structure. Such non bridging substituents may be at any position of the furanosyl, including but not limited to substituents at the 2', 4', and/or 5' positions. In certain embodiments one or more non-bridging substituent of non-bicyclic modified sugar moieties is branched. Examples of 2'-substituent groups suitable for non-bicyclic modified sugar moieties include but are not limited to: 2'-F, 2'-$OCH_3$ ("OMe" or "O-methyl"), and 2'-$O(CH_2)_2OCH_3$ ("MOE"). In certain embodiments, 2'-substituent groups are selected from among: halo, allyl, amino, azido, SH, CN, OCN, $CF_3$, $OCF_3$, O—$C_1$-$C_{10}$ alkoxy, O—$C_1$-$C_{10}$ substituted alkoxy, O—$C_1$-$C_{10}$ alkyl, O—$C_1$-$C_{10}$ substituted alkyl, S-alkyl, N($R_m$)-alkyl, O-alkenyl, S-alkenyl, N($R_m$)-alkenyl, O-alkynyl, S-alkynyl, N($R_m$)-alkynyl, O-alkylenyl-O-alkyl, alkynyl, alkaryl, aralkyl, O-alkaryl, O-aralkyl, $O(CH_2)_2SCH_3$, $O(CH_2)_2ON(R_m)(R_n)$ or $OCH_2C(=O)—N(R_m)(R_n)$, where each $R_m$ and $R_n$ is, independently, H, an amino protecting group, or substituted or unsubstituted $C_1$-$C_{10}$ alkyl, and the 2'-substituent groups described in Cook et al., U.S. Pat. No. 6,531,584; Cook et al., U.S. Pat. No. 5,859,221; and Cook et al., U.S. Pat. No. 6,005,087. Certain embodiments of these 2'-substituent groups can be further substituted with one or more substituent groups independently selected from among: hydroxyl, amino, alkoxy, carboxy, benzyl, phenyl, nitro ($NO_2$), thiol, thioalkoxy, thioalkyl, halogen, alkyl, aryl, alkenyl and alkynyl. Examples of 4'-substituent groups suitable for non-bicyclic modified sugar moieties include but are not limited to alkoxy (e.g., methoxy), alkyl, and those described in Manoharan et al., WO 2015/106128. Examples of 5'-substituent groups suitable for non-bicyclic modified sugar moieties include but are not limited to: 5-methyl (R or S), 5'-vinyl, and 5'-methoxy. In certain embodiments, non-bicyclic modified sugar moieties comprise more than one non-bridging sugar substituent, for example, 2'-F-5'-methyl sugar moieties and the modified sugar moieties and modified nucleosides described in Migawa et al., WO 2008/101157 and Rajeev et al., US2013/0203836.).

In certain embodiments, a 2'-substituted non-bicyclic modified nucleoside comprises a sugar moiety comprising a non-bridging 2'-substituent group selected from: F, $NH_2$, $N_3$, $OCF_3$, $OCH_3$, $O(CH_2)_3NH_2$, $CH_2CH=CH_2$, $OCH_2CH=CH_2$, $OCH_2CH_2OCH_3$, $O(CH_2)_2SCH_3$, $O(CH_2)_2$ $ON(R_m)(R_n)$, $O(CH_2)_2O(CH_2)_2N(CH_3)_2$, and N-substituted acetamide ($OCH_2C(=O)—N(R_m)(R_n)$), where each $R_m$ and $R_n$ is, independently, H, an amino protecting group, or substituted or unsubstituted $C_1$-$C_{10}$ alkyl.

In certain embodiments, a 2'-substituted nucleoside non-bicyclic modified nucleoside comprises a sugar moiety comprising a non-bridging 2'-substituent group selected from: F, $OCF_3$, $OCH_3$, $OCH_2CH_2OCH_3$, $O(CH_2)_2SCH_3$, $O(CH_2)_2ON(CH_3)_2$, $O(CH_2)_2O(CH_2)_2N(CH_3)_2$, and $OCH_2C(=O)—N(H)CH_3$ ("NMA").

In certain embodiments, a 2'-substituted non-bicyclic modified nucleoside comprises a sugar moiety comprising a non-bridging 2'-substituent group selected from: F, $OCH_3$, and $OCH_2CH_2OCH_3$.

Certain modified sugar moieties comprise a substituent that bridges two atoms of the furanosyl ring to form a second ring, resulting in a bicyclic sugar moiety. In certain such embodiments, the bicyclic sugar moiety comprises a bridge between the 4' and the 2' furanose ring atoms. Examples of such 4' to 2' bridging sugar substituents include but are not limited to: 4'-$CH_2$-2', 4'-$(CH_2)_2$-2', 4'-$(CH_2)_3$-2', 4'-$CH_2$—O-2' ("LNA"), 4'-$CH_2$—S-2', 4'-$(CH_2)_2$—O-2' ("ENA"), 4'-$CH(CH_3)$—O-2' (referred to as "constrained ethyl" or "cEt"), 4'-$CH_2$—O—$CH_2$-2', 4'-$CH_2$—N(R)-2', 4'-CH($CH_2OCH_3$)—O-2' ("constrained MOE" or "cMOE") and analogs thereof (see, e.g., Seth et al., U.S. Pat. No. 7,399,845, Bhat et al., U.S. Pat. No. 7,569,686, Swayze et al., U.S. Pat. No. 7,741,457, and Swayze et al., U.S. Pat. No. 8,022,193), 4'-$C(CH_3)(CH_3)$—O-2' and analogs thereof (see, e.g., Seth et al., U.S. Pat. No. 8,278,283), 4'-$CH_2$—N($OCH_3$)-2' and analogs thereof (see, e.g., Prakash et al., U.S. Pat. No. 8,278,425), 4'-$CH_2$—O—N($CH_3$)-2' (see, e.g., Allerson et al., U.S. Pat. No. 7,696,345 and Allerson et al., U.S. Pat. No. 8,124,745), 4'-$CH_2$—C(H)($CH_3$)-2' (see, e.g., Zhou, et al., *J. Org. Chem.*, 2009, 74, 118-134), 4'-$CH_2$—C(=$CH_2$)-2' and analogs thereof (see e.g., Seth et al., U.S. Pat. No. 8,278,426), 4'-C($R_aR_b$)—N(R)—O-2', 4'-C($R_aR_b$)—O—N(R)-2', 4'-$CH_2$—O—N(R)-2', and 4'-$CH_2$—N(R)—O-2', wherein each R, $R_a$, and $R_b$ is, independently, H, a protecting group, or $C_1$-$C_{12}$ alkyl (see, e.g. Imanishi et al., U.S. Pat. No. 7,427,672).

In certain embodiments, such 4' to 2' bridges independently comprise from 1 to 4 linked groups independently selected from: —[C($R_a$)($R_b$)]$_n$—, —[C($R_a$)($R_b$)]$_n$—O—, —C($R_a$)=C($R_b$)—, —C($R_a$)=N—, —C(=$NR_a$)—, —C(=O)—, —C(=S)—, —O—, —Si($R_a$)$_2$—, —S(=O)$_x$—, and —N($R_a$)—;

wherein:

x is 0, 1, or 2;

n is 1, 2, 3, or 4;

each $R_a$ and $R_b$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, heterocycle radical, substituted heterocycle radical, heteroaryl, substituted heteroaryl, $C_5$-$C_7$ alicyclic radical, substituted $C_5$-$C_7$ alicyclic radical, halogen, $OJ_1$, $NJ_1J_2$, $SJ_1$, $N_3$, $COOJ_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl, or a protecting group.

Additional bicyclic sugar moieties are known in the art, see, for example: Freier et al., *Nucleic Acids Research*, 1997, 25(22), 4429-4443, Albaek et al., *J Org. Chem.*, 2006, 71, 7731-7740, Singh et al., *Chem. Commun.*, 1998, 4, 455-456; Koshkin et al., *Tetrahedron*, 1998, 54, 3607-3630; Kumar et al., *Bioorg. Med. Chem. Lett.*, 1998, 8, 2219-2222; Singh et al., *J. Org. Chem.*, 1998, 63, 10035-10039; Srivastava et al., *J Am. Chem. Soc.*, 2007, 129, 8362-8379; Wengel et a., U.S. Pat. No. 7,053,207; Imanishi et al., U.S. Pat. No. 6,268,490; Imanishi et al. U.S. Pat. No. 6,770,748; Imanishi et al., U.S. RE44,779; Wengel et al., U.S. Pat. No. 6,794,499; Wengel et al., U.S. Pat. No. 6,670,461; Wengel et al., U.S. Pat. No. 7,034,133; Wengel et al., U.S. Pat. No. 8,080,644; Wengel et al., U.S. Pat. No. 8,034,909; Wengel et al., U.S. Pat. No. 8,153,365; Wengel et al., U.S. Pat. No. 7,572,582; and Ramasamy et al., U.S. Pat. No. 6,525,191; Torsten et al., WO 2004/106356; Wengel et al., WO 1999/014226; Seth et al., WO 2007/134181; Seth et al., U.S. Pat. No. 7,547,684; Seth et al., U.S. Pat. No. 7,666,854; Seth et al., U.S. Pat. No. 8,088,746; Seth et al., U.S. Pat. No. 7,750,131; Seth et al., U.S. Pat. No. 8,030,467; Seth et al., U.S. Pat. No. 8,268,980; Seth et al., U.S. Pat. No. 8,546,556; Seth et al., U.S. Pat. No. 8,530,640; Migawa et al., U.S. Pat. No. 9,012,421; Seth et al., U.S. Pat. No. 8,501,805; and U.S. Patent Publication Nos. Allerson et al., US2008/0039618 and Migawa et al., US2015/0191727.

In certain embodiments, bicyclic sugar moieties and nucleosides incorporating such bicyclic sugar moieties are further defined by isomeric configuration. For example, an LNA nucleoside (described herein) may be in the α-L configuration or in the β-D configuration.

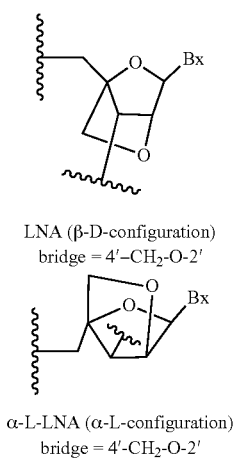

LNA (β-D-configuration)
bridge = 4'-CH$_2$-O-2'

α-L-LNA (α-L-configuration)
bridge = 4'-CH$_2$-O-2'

α-L-methyleneoxy (4'-CH$_2$—O-2') or α-L-LNA bicyclic nucleosides have been incorporated into oligonucleotides that showed antisense activity (Frieden et al., *Nucleic Acids Research*, 2003, 21, 6365-6372). Herein, general descriptions of bicyclic nucleosides include both isomeric configurations. When the positions of specific bicyclic nucleosides (e.g., LNA or cEt) are identified in exemplified embodiments herein, they are in the β-D configuration, unless otherwise specified.

In certain embodiments, modified sugar moieties comprise one or more non-bridging sugar substituent and one or more bridging sugar substituent (e.g., 5'-substituted and 4'-2' bridged sugars).

In certain embodiments, modified sugar moieties are sugar surrogates. In certain such embodiments, the oxygen atom of the sugar moiety is replaced, e.g., with a sulfur, carbon or nitrogen atom. In certain such embodiments, such modified sugar moieties also comprise bridging and/or non-bridging substituents as described herein. For example, certain sugar surrogates comprise a 4'-sulfur atom and a substitution at the 2'-position (see, e.g., Bhat et al., U.S. Pat. No. 7,875,733 and Bhat et al., U.S. Pat. No. 7,939,677) and/or the 5' position.

In certain embodiments, sugar surrogates comprise rings having other than 5 atoms. For example, in certain embodiments, a sugar surrogate comprises a six-membered tetrahydropyran ("THP"). Such tetrahydropyrans may be further modified or substituted. Nucleosides comprising such modified tetrahydropyrans include but are not limited to hexitol nucleic acid ("HNA"), anitol nucleic acid ("ANA"), manitol nucleic acid ("MNA") (see, e.g., Leumann, CJ. *Bioorg. & Med. Chem.* 2002, 10, 841-854), fluoro HNA:

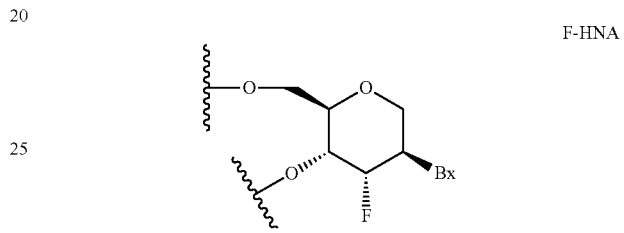

F-HNA ("F-HNA", see e.g. Swayze et al., U.S. Pat. No. 8,088,904; Swayze et al., U.S. Pat. No. 8,440,803; Swayze et al., U.S. Pat. No. 8,796,437; and Swayze et al., U.S. Pat. No. 9,005,906; F-HNA can also be referred to as a F-THP or 3'-fluoro tetrahydropyran), and nucleosides comprising additional modified THP compounds having the formula:

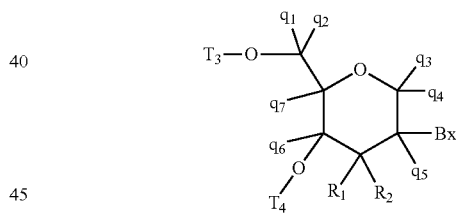

wherein, independently, for each of said modified THP nucleoside:

Bx is a nucleobase moiety;

$T_3$ and $T_4$ are each, independently, an internucleoside linking group linking the modified THP nucleoside to the remainder of an oligonucleotide or one of $T_3$ and $T_4$ is an internucleoside linking group linking the modified THP nucleoside to the remainder of an oligonucleotide and the other of $T_3$ and $T_4$ is H, a hydroxyl protecting group, a linked conjugate group, or a 5' or 3'-terminal group;

$q_1$, $q_2$, $q_3$, $q_4$, $q_5$, $q_6$ and $q_7$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, or substituted $C_2$-$C_6$ alkynyl; and each of $R_1$ and $R_2$ is independently selected from among: hydrogen, halogen, substituted or unsubstituted alkoxy, $NJ_1J_2$, $SJ_1$, $N_3$, OC(=X)$J_1$, OC(=X)$NJ_1J_2$, $NJ_3$C(=X)$NJ_1J_2$, and CN, wherein X is O, S or $NJ_1$, and each $J_1$, $J_2$, and $J_3$ is, independently, H or $C_1$-$C_6$ alkyl.

In certain embodiments, modified THP nucleosides are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, modified THP nucleosides are provided wherein one of $R_1$ and $R_2$ is F. In certain embodiments, $R_1$ is F and $R_2$ is H, in certain embodiments, $R_1$ is methoxy and $R_2$ is H, and in certain embodiments, $R_1$ is methoxyethoxy and $R_2$ is H.

In certain embodiments, sugar surrogates comprise rings having more than 5 atoms and more than one heteroatom. For example, nucleosides comprising morpholino sugar moieties and their use in oligonucleotides have been reported (see, e.g., Braasch et al., Biochemistry, 2002, 41, 4503-4510 and Summerton et al., U.S. Pat. No. 5,698,685; Summerton et al., U.S. Pat. No. 5,166,315; Summerton et al., U.S. Pat. No. 5,185,444; and Summerton et al., U.S. Pat. No. 5,034,506). As used here, the term "morpholino" means a sugar surrogate having the following structure:

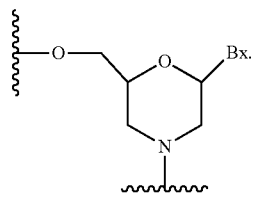

In certain embodiments, morpholinos may be modified, for example by adding or altering various substituent groups from the above morpholino structure. Such sugar surrogates are referred to herein as "modified morpholinos."

In certain embodiments, sugar surrogates comprise acyclic moieties. Examples of nucleosides and oligonucleotides comprising such acyclic sugar surrogates include but are not limited to: peptide nucleic acid ("PNA"), acyclic butyl nucleic acid (see, e.g., Kumar et al., Org. Biomol. Chem., 2013, 11, 5853-5865), and nucleosides and oligonucleotides described in Manoharan et al., WO2011/133876.

Many other bicyclic and tricyclic sugar and sugar surrogate ring systems are known in the art that can be used in modified nucleosides.

2. Certain Modified Nucleobases

In certain embodiments, modified oligonucleotides comprise one or more nucleoside comprising an unmodified nucleobase. In certain embodiments, modified oligonucleotides comprise one or more nucleoside comprising a modified nucleobase. In certain embodiments, modified oligonucleotides comprise one or more nucleoside that does not comprise a nucleobase, referred to as an abasic nucleoside.

In certain embodiments, modified nucleobases are selected from: 5-substituted pyrimidines, 6-azapyrimidines, alkyl or alkynyl substituted pyrimidines, alkyl substituted purines, and N-2, N-6 and O-6 substituted purines. In certain embodiments, modified nucleobases are selected from: 2-aminopropyladenine, 5-hydroxymethyl cytosine, xanthine, hypoxanthine, 2-aminoadenine, 6-N-methylguanine, 6-N-methyladenine, 2-propyladenine, 2-thiouracil, 2-thiothymine and 2-thiocytosine, 5-propynyl ($-C\equiv C-CH_3$) uracil, 5-propynylcytosine, 6-azouracil, 6-azocytosine, 6-azothymine, 5-ribosyluracil (pseudouracil), 4-thiouracil, 8-halo, 8-amino, 8-thiol, 8-thioalkyl, 8-hydroxyl, 8-aza and other 8-substituted purines, 5-halo, particularly 5-bromo, 5-trifluoromethyl, 5-halouracil, and 5-halocytosine, 7-methylguanine, 7-methyladenine, 2-F-adenine, 2-aminoadenine, 7-deazaguanine, 7-deazaadenine, 3-deazaguanine, 3-deazaadenine, 6-N-benzoyladenine, 2-N-isobutyrylguanine, 4-N-benzoylcytosine, 4-N-benzoyluracil, 5-methyl 4-N-benzoylcytosine, 5-methyl 4-N-benzoyluracil, universal bases, hydrophobic bases, promiscuous bases, size-expanded bases, and fluorinated bases. Further modified nucleobases include tricyclic pyrimidines, such as 1,3-diazaphenoxazine-2-one, 1,3-diazaphenothiazine-2-one and 9-(2-aminoethoxy)-1,3-diazaphenoxazine-2-one (G-clamp). Modified nucleobases may also include those in which the purine or pyrimidine base is replaced with other heterocycles, for example 7-deaza-adenine, 7-deazaguanosine, 2-aminopyridine and 2-pyridone. Further nucleobases include those disclosed in Merigan et al., U.S. Pat. No. 3,687,808, those disclosed in *The Concise Encyclopedia Of Polymer Science And Engineering*, Kroschwitz, J. I., Ed., John Wiley & Sons, 1990, 858-859; Englisch et al., *Angewandte Chemie*, International Edition, 1991, 30, 613; Sanghvi, Y. S., Chapter 15, *Antisense Research and Applications*, Crooke, S. T. and Lebleu, B., Eds., CRC Press, 1993, 273-288; and those disclosed in Chapters 6 and 15, *Antisense Drug Technology*, Crooke S. T., Ed., CRC Press, 2008, 163-166 and 442-443.

Publications that teach the preparation of certain of the above noted modified nucleobases as well as other modified nucleobases include without limitation, Manohara et al., US2003/0158403; Manoharan et al., US2003/0175906; Dinh et al., U.S. Pat. No. 4,845,205; Spielvogel et al., U.S. Pat. No. 5,130,302; Rogers et al., U.S. Pat. No. 5,134,066; Bischofberger et al., U.S. Pat. No. 5,175,273; Urdea et al., U.S. Pat. No. 5,367,066; Benner et al., U.S. Pat. No. 5,432,272; Matteucci et al., U.S. Pat. No. 5,434,257; Gmeiner et al., U.S. Pat. No. 5,457,187; Cook et al., U.S. Pat. No. 5,459,255; Froehler et al., U.S. Pat. No. 5,484,908; Matteucci et al., U.S. Pat. No. 5,502,177; Hawkins et al., U.S. Pat. No. 5,525,711; Haralambidis et al., U.S. Pat. No. 5,552,540; Cook et al., U.S. Pat. No. 5,587,469; Froehler et al., U.S. Pat. No. 5,594,121; Switzer et al., U.S. Pat. No. 5,596,091; Cook et al., U.S. Pat. No. 5,614,617; Froehler et al., U.S. Pat. No. 5,645,985; Cook et al., U.S. Pat. No. 5,681,941; Cook et al., U.S. Pat. No. 5,811,534; Cook et al., U.S. Pat. No. 5,750,692; Cook et al., U.S. Pat. No. 5,948,903; Cook et al., U.S. Pat. No. 5,587,470; Cook et al., U.S. Pat. No. 5,457,191; Matteucci et al., U.S. Pat. No. 5,763,588; Froehler et al., U.S. Pat. No. 5,830,653; Cook et al., U.S. Pat. No. 5,808,027; Cook et al., 6,166,199; and Matteucci et al., U.S. Pat. No. 6,005,096.

3. Certain Modified Internucleoside Linkages

In certain embodiments, nucleosides of modified oligonucleotides may be linked together using any internucleoside linkage. The two main classes of internucleoside linking groups are defined by the presence or absence of a phosphorus atom. Representative phosphorus-containing internucleoside linkages include but are not limited to phosphates, which contain a phosphodiester bond ("P=O") (also referred to as unmodified or naturally occurring linkages), phosphotriesters, methylphosphonates, phosphoramidates, and phosphorothioates ("P=S"), and phosphorodithioates ("HS—P=S"). Representative non-phosphorus containing internucleoside linking groups include but are not limited to methylenemethylimino ($-CH_2-N(CH_3)-O-CH_2-$), thiodiester, thionocarbamate ($-O-C(=O)(NH)-S-$); siloxane ($-O-SiH_2-O-$); and N,N'-dimethylhydrazine ($-CH_2-N(CH_3)-N(CH_3)-$). Modified internucleoside linkages, compared to naturally occurring phosphate linkages, can be used to alter, typically increase, nuclease resistance of the oligonucleotide. In certain embodiments, internucleoside linkages having a chiral atom can be prepared as a racemic mixture, or as separate enantiomers. Methods of preparation of phosphorous-containing and non-phosphorous-containing internucleoside linkages are well known to those skilled in the art.

Representative internucleoside linkages having a chiral center include but are not limited to alkylphosphonates and phosphorothioates. Modified oligonucleotides comprising internucleoside linkages having a chiral center can be prepared as populations of modified oligonucleotides comprising stereorandom internucleoside linkages, or as populations of modified oligonucleotides comprising phosphorothioate linkages in particular stereochemical configurations. In certain embodiments, populations of modified oligonucleotides comprise phosphorothioate internucleoside linkages wherein all of the phosphorothioate internucleoside linkages are stereorandom. Such modified oligonucleotides can be generated using synthetic methods that result in random selection of the stereochemical configuration of each phosphorothioate linkage. Nonetheless, as is well understood by those of skill in the art, each individual phosphorothioate of each individual oligonucleotide molecule has a defined stereoconfiguration. In certain embodiments, populations of modified oligonucleotides are enriched for modified oligonucleotides comprising one or more particular phosphorothioate internucleoside linkages in a particular, independently selected stereochemical configuration. In certain embodiments, the particular configuration of the particular phosphorothioate linkage is present in at least 65% of the molecules in the population. In certain embodiments, the particular configuration of the particular phosphorothioate linkage is present in at least 70% of the molecules in the population. In certain embodiments, the particular configuration of the particular phosphorothioate linkage is present in at least 80% of the molecules in the population. In certain embodiments, the particular configuration of the particular phosphorothioate linkage is present in at least 90% of the molecules in the population. In certain embodiments, the particular configuration of the particular phosphorothioate linkage is present in at least 99% of the molecules in the population. Such chirally enriched populations of modified oligonucleotides can be generated using synthetic methods known in the art, e.g., methods described in Oka et al., JACS 125, 8307 (2003), Wan et al. *Nuc. Acid. Res.* 42, 13456 (2014), and WO 2017/015555. In certain embodiments, a population of modified oligonucleotides is enriched for modified oligonucleotides having at least one indicated phosphorothioate in the (Sp) configuration. In certain embodiments, a population of modified oligonucleotides is enriched for modified oligonucleotides having at least one phosphorothioate in the (Rp) configuration. In certain embodiments, modified oligonucleotides comprising (Rp) and/or (Sp) phosphorothioates comprise one or more of the following formulas, respectively, wherein "B" indicates a nucleobase:

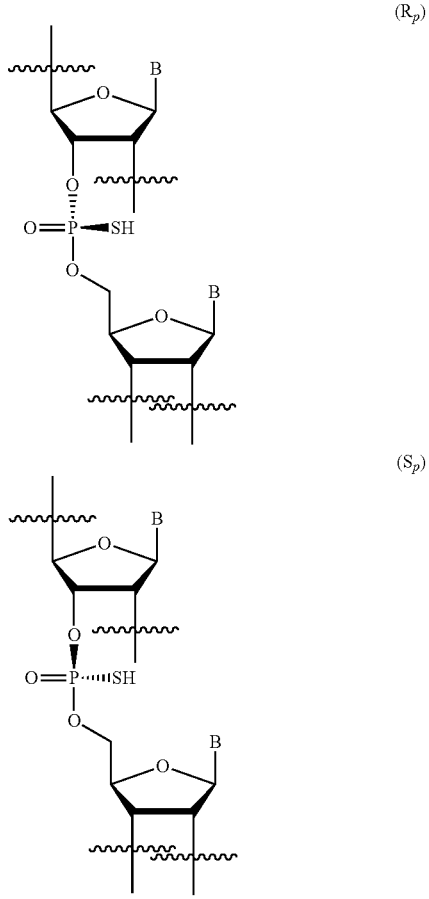

Unless otherwise indicated, chiral internucleoside linkages of modified oligonucleotides described herein can be stereorandom or in a particular stereochemical configuration.

Neutral internucleoside linkages include, without limitation, phosphotriesters, methylphosphonates, MMI (3'-CH$_2$—N(CH$_3$)—O-5'), amide-3 (3'-CH$_2$—C(=O)—N(H)-5'), amide-4 (3'-CH$_2$—N(H)—C(=O)-5'), formacetal (3'-O—CH$_2$—O-5'), methoxypropyl, and thioformacetal (3'-S—CH$_2$—O-5'). Further neutral internucleoside linkages include nonionic linkages comprising siloxane (dialkylsiloxane), carboxylate ester, carboxamide, sulfide, sulfonate ester and amides (See for example: *Carbohydrate Modifications in Antisense Research*; Y. S. Sanghvi and P. D. Cook, Eds., ACS Symposium Series 580; Chapters 3 and 4, 40-65). Further neutral internucleoside linkages include nonionic linkages comprising mixed N, O, S and CH$_2$ component parts.

B. Certain Motifs

In certain embodiments, modified oligonucleotides comprise one or more modified nucleosides comprising a modified sugar moiety. In certain embodiments, modified oligonucleotides comprise one or more modified nucleosides comprising a modified nucleobase. In certain embodiments, modified oligonucleotides comprise one or more modified internucleoside linkage. In such embodiments, the modified, unmodified, and differently modified sugar moieties, nucleobases, and/or internucleoside linkages of a modified oligonucleotide define a pattern or motif. In certain embodiments, the patterns of sugar moieties, nucleobases, and internucleoside linkages are each independent of one another. Thus, a modified oligonucleotide may be described by its sugar motif, nucleobase motif and/or internucleoside linkage motif (as used herein, nucleobase motif describes the modifications to the nucleobases independent of the sequence of nucleobases).

1. Certain Sugar Motifs

In certain embodiments, oligonucleotides comprise one or more type of modified sugar and/or unmodified sugar moiety arranged along the oligonucleotide or region thereof in a defined pattern or sugar motif. In certain instances, such sugar motifs include but are not limited to any of the sugar modifications discussed herein.

In certain embodiments, modified oligonucleotides comprise or consist of a region having a gapmer motif, which is defined by two external regions or "wings" and a central or internal region or "gap." The three regions of a gapmer motif (the 5'-wing, the gap, and the 3'-wing) form a contiguous sequence of nucleosides wherein at least some of the sugar moieties of the nucleosides of each of the wings differ from at least some of the sugar moieties of the nucleosides of the gap. Specifically, at least the sugar moieties of the nucleosides of each wing that are closest to the gap (the 3'-most nucleoside of the 5'-wing and the 5'-most nucleoside of the 3'-wing) differ from the sugar moiety of the neighboring gap nucleosides, thus defining the boundary between the wings and the gap (i.e., the wing/gap junction). In certain embodiments, the sugar moieties within the gap are the same as one another. In certain embodiments, the gap includes one or more nucleoside having a sugar moiety that differs from the sugar moiety of one or more other nucleosides of the gap. In certain embodiments, the sugar motifs of the two wings are the same as one another (symmetric gapmer). In certain embodiments, the sugar motif of the 5'-wing differs from the sugar motif of the 3'-wing (asymmetric gapmer).

In certain embodiments, the wings of a gapmer comprise 1-5 nucleosides. In certain embodiments, each nucleoside of each wing of a gapmer is a modified nucleoside. In certain embodiments, at least one nucleoside of each wing of a gapmer is a modified nucleoside. In certain embodiments, at least two nucleosides of each wing of a gapmer are modified nucleosides. In certain embodiments, at least three nucleosides of each wing of a gapmer are modified nucleosides. In certain embodiments, at least four nucleosides of each wing of a gapmer are modified nucleosides.

In certain embodiments, the gap of a gapmer comprises 7-12 nucleosides. In certain embodiments, each nucleoside of the gap of a gapmer is an unmodified 2'-deoxy nucleoside. In certain embodiments, at least one nucleoside of the gap of a gapmer is a modified nucleoside.

In certain embodiments, the gapmer is a deoxy gapmer. In certain embodiments, the nucleosides on the gap side of each wing/gap junction are unmodified 2'-deoxy nucleosides and the nucleosides on the wing sides of each wing/gap junction are modified nucleosides. In certain embodiments, each nucleoside of the gap is an unmodified 2'-deoxy nucleoside. In certain embodiments, each nucleoside of each wing of a gapmer is a modified nucleoside.

In certain embodiments, modified oligonucleotides comprise or consist of a region having a fully modified sugar motif. In such embodiments, each nucleoside of the fully modified region of the modified oligonucleotide comprises a modified sugar moiety. In certain embodiments, each nucleoside of the entire modified oligonucleotide comprises a modified sugar moiety. In certain embodiments, modified oligonucleotides comprise or consist of a region having a fully modified sugar motif, wherein each nucleoside within the fully modified region comprises the same modified sugar moiety, referred to herein as a uniformly modified sugar motif. In certain embodiments, a fully modified oligonucleotide is a uniformly modified oligonucleotide. In certain embodiments, each nucleoside of a uniformly modified comprises the same 2'-modification.

Herein, the lengths (number of nucleosides) of the three regions of a gapmer may be provided using the notation [# of nucleosides in the 5'-wing]–[# of nucleosides in the gap]–[# of nucleosides in the 3'-wing]. Thus, a 5-10-5 gapmer consists of 5 linked nucleosides in each wing and 10 linked nucleosides in the gap. Where such nomenclature is followed by a specific modification, that modification is the modification in each sugar moiety of each wing and the gap nucleosides comprise unmodified deoxynucleosides sugars. Thus, a 5-10-5 MOE gapmer consists of 5 linked MOE modified nucleosides in the 5'-wing, 10 linked deoxynucleosides in the gap, and 5 linked MOE nucleosides in the 3'-wing.

In certain embodiments, modified oligonucleotides are 5-10-5 MOE gapmers. In certain embodiments, modified oligonucleotides are 3-10-3 BNA gapmers. In certain embodiments, modified oligonucleotides are 3-10-3 cEt gapmers. In certain embodiments, modified oligonucleotides are 3-10-3 LNA gapmers.

2. Certain Nucleobase Motifs

In certain embodiments, oligonucleotides comprise modified and/or unmodified nucleobases arranged along the oligonucleotide or region thereof in a defined pattern or motif. In certain embodiments, each nucleobase is modified. In certain embodiments, none of the nucleobases are modified. In certain embodiments, each purine or each pyrimidine is modified. In certain embodiments, each adenine is modified. In certain embodiments, each guanine is modified. In certain embodiments, each thymine is modified. In certain embodiments, each uracil is modified. In certain embodiments, each cytosine is modified. In certain embodiments, some or all of the cytosine nucleobases in a modified oligonucleotide are 5-methyl cytosines. In certain embodiments, all of the cytosine nucleobases are 5-methyl cytosines and all of the other nucleobases of the modified oligonucleotide are unmodified nucleobases.

In certain embodiments, modified oligonucleotides comprise a block of modified nucleobases. In certain such embodiments, the block is at the 3'-end of the oligonucleotide. In certain embodiments the block is within 3 nucleosides of the 3'-end of the oligonucleotide. In certain embodiments, the block is at the 5'-end of the oligonucleotide. In certain embodiments the block is within 3 nucleosides of the 5'-end of the oligonucleotide.

In certain embodiments, oligonucleotides having a gapmer motif comprise a nucleoside comprising a modified nucleobase. In certain such embodiments, one nucleoside comprising a modified nucleobase is in the central gap of an oligonucleotide having a gapmer motif. In certain such embodiments, the sugar moiety of said nucleoside is a 2'-deoxyribosyl moiety. In certain embodiments, the modified nucleobase is selected from: a 2-thiopyrimidine and a 5-propynepyrimidine.

3. Certain Internucleoside Linkage Motifs In certain embodiments, oligonucleotides comprise modified and/or unmodified internucleoside linkages arranged along the oligonucleotide or region thereof in a defined pattern or motif. In certain embodiments, each internucleoside linking group is a phosphodiester internucleoside linkage (P=O). In certain embodiments, each internucleoside linking group of a modified oligonucleotide is a phosphorothioate internucleoside linkage (P=S). In certain embodiments, each internucleoside linkage of a modified oligonucleotide is independently selected from a phosphorothioate internucleoside linkage and phosphodiester internucleoside linkage. In certain embodiments, each phosphorothioate internucleoside linkage is independently selected from a stereorandom phosphorothioate a (Sp) phosphorothioate, and a (Rp) phosphorothioate. In certain embodiments, the sugar motif of a modified oligonucleotide is a gapmer and the internucleoside linkages within the gap are all modified. In certain such embodiments, some or all of the internucleoside linkages in the wings are unmodified phosphodiester internucleoside linkages. In certain embodiments, the terminal internucleoside linkages are modified. In certain embodiments, the sugar motif of a modified oligonucleotide is a gapmer, and the internucleoside linkage motif comprises at least one phosphodiester internucleoside linkage in at least one wing, wherein the at least one phosphodiester linkage is not a terminal internucleoside linkage, and the remaining internucleoside linkages are phosphorothioate internucleoside linkages. In certain such embodiments, all of the phosphorothioate linkages are stereorandom. In certain embodiments, all of the phosphorothioate linkages in the wings are (Sp) phosphorothioates, and the gap comprises at least one Sp, Sp, Rp motif. In certain embodiments, populations of modified oligonucleotides are enriched for modified oligonucleotides comprising such internucleoside linkage motifs.

C. Certain Lengths

It is possible to increase or decrease the length of an oligonucleotide without eliminating activity. For example, in Woolf et al. (Proc. Natl. Acad. Sci. USA 89:7305-7309, 1992), a series of oligonucleotides 13-25 nucleobases in length were tested for their ability to induce cleavage of a target RNA in an oocyte injection model. Oligonucleotides 25 nucleobases in length with 8 or 11 mismatch bases near the ends of the oligonucleotides were able to direct specific cleavage of the target RNA, albeit to a lesser extent than the oligonucleotides that contained no mismatches. Similarly, target specific cleavage was achieved using 13 nucleobase oligonucleotides, including those with 1 or 3 mismatches.

In certain embodiments, oligonucleotides (including modified oligonucleotides) can have any of a variety of ranges of lengths. In certain embodiments, oligonucleotides consist of X to Y linked nucleosides, where X represents the fewest number of nucleosides in the range and Y represents the largest number nucleosides in the range. In certain such embodiments, X and Y are each independently selected from 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50; provided that X≤Y. For example, in certain embodiments, oligonucleotides consist of 12 to 13, 12 to 14, 12 to 15, 12 to 16, 12 to 17, 12 to 18, 12 to 19, 12 to 20, 12 to 21, 12 to 22, 12 to 23, 12 to 24, 12 to 25, 12 to 26, 12 to 27, 12 to 28, 12 to 29, 12 to 30, 13 to 14, 13 to 15, 13 to 16, 13 to 17, 13 to 18, 13 to 19, 13 to 20, 13 to 21, 13 to 22, 13 to 23, 13 to 24, 13 to 25, 13 to 26, 13 to 27, 13 to 28, 13 to 29, 13 to 30, 14 to 15, 14 to 16, 14 to 17, 14 to 18, 14 to 19, 14 to 20, 14 to 21, 14 to 22, 14 to 23, 14 to 24, 14 to 25, 14 to 26, 14 to 27, 14 to 28, 14 to 29, 14 to 30, 15 to 16, 15 to 17, 15 to 18, 15 to 19, 15 to 20, 15 to 21, 15 to 22, 15 to 23, 15 to 24, 15 to 25, 15 to 26, 15 to 27, 15 to 28, 15 to 29, 15 to 30, 16 to 17, 16 to 18, 16 to 19, 16 to 20, 16 to 21, 16 to 22, 16 to 23, 16 to 24, 16 to 25, 16 to 26, 16 to 27, 16 to 28, 16 to 29, 16 to 30, 17 to 18, 17 to 19, 17 to 20, 17 to 21, 17 to 22, 17 to 23, 17 to 24, 17 to 25, 17 to 26, 17 to 27, 17 to 28, 17 to 29, 17 to 30, 18 to 19, 18 to 20, 18 to 21, 18 to 22, 18 to 23, 18 to 24, 18 to 25, 18 to 26, 18 to 27, 18 to 28, 18 to 29, 18 to 30, 19 to 20, 19 to 21, 19 to 22, 19 to 23, 19 to 24, 19 to 25, 19 to 26, 19 to 29, 19 to 28, 19 to 29, 19 to 30, 20 to 21, 20 to 22, 20 to 23, 20 to 24, 20 to 25, 20 to 26, 20 to 27, 20 to 28, 20 to 29, 20 to 30, 21 to 22, 21 to 23, 21 to 24, 21 to 25, 21 to 26, 21 to 27, 21 to 28, 21 to 29, 21 to 30, 22 to 23, 22 to 24, 22 to 25, 22 to 26, 22 to 27, 22 to 28, 22 to 29, 22 to 30, 23 to 24, 23 to 25, 23 to 26, 23 to 27, 23 to 28, 23 to 29, 23 to 30, 24 to 25, 24 to 26, 24 to 27, 24 to 28, 24 to 29, 24 to 30, 25 to 26, 25 to 27, 25 to 28, 25 to 29, 25 to 30, 26 to 27, 26 to 28, 26 to 29, 26 to 30, 27 to 28, 27 to 29, 27 to 30, 28 to 29, 28 to 30, or 29 to 30 linked nucleosides D. Certain Modified Oligonucleotides In certain embodiments, the above modifications (sugar, nucleobase, internucleoside linkage) are incorporated into a modified oligonucleotide. In certain embodiments, modified oligonucleotides are characterized by their modification motifs and overall lengths. In certain embodiments, such parameters are each independent of one another. Thus, unless otherwise indicated, each internucleoside linkage of an oligonucleotide having a gapmer sugar motif may be modified or unmodified and may or may not follow the gapmer modification pattern of the sugar modifications. For example, the internucleoside linkages within the wing regions of a sugar gapmer may be the same or different from one another and may be the same or different from the internucleoside linkages of the gap region of the sugar motif. Likewise, such sugar gapmer oligonucleotides may comprise one or more modified nucleobase independent of the gapmer pattern of the sugar modifications. Unless otherwise indicated, all modifications are independent of nucleobase sequence.

E. Certain Populations of Modified Oligonucleotides

Populations of modified oligonucleotides in which all of the modified oligonucleotides of the population have the same molecular formula can be stereorandom populations or chirally enriched populations. All of the chiral centers of all of the modified oligonucleotides are stereorandom in a stereorandom population. In a chirally enriched population, at least one particular chiral center is not stereorandom in the modified oligonucleotides of the population. In certain embodiments, the modified oligonucleotides of a chirally enriched population are enriched for β-D ribosyl sugar moieties, and all of the phosphorothioate internucleoside linkages are stereorandom. In certain embodiments, the modified oligonucleotides of a chirally enriched population are enriched for both β-D ribosyl sugar moieties and at least one, particular phosphorothioate internucleoside linkage in a particular stereochemical configuration.

F. Nucleobase Sequence

In certain embodiments, oligonucleotides (unmodified or modified oligonucleotides) are further described by their nucleobase sequence. In certain embodiments oligonucleotides have a nucleobase sequence that is complementary to a second oligonucleotide or an identified reference nucleic acid, such as a target nucleic acid. In certain such embodiments, a region of an oligonucleotide has a nucleobase sequence that is complementary to a second oligonucleotide or an identified reference nucleic acid, such as a target nucleic acid. In certain embodiments, the nucleobase sequence of a region or entire length of an oligonucleotide is at least 50%, at least 60%, at least 70%, at least 80%, at least 85%, at least 90%, at least 95%, or 100% complementary to the second oligonucleotide or nucleic acid, such as a target nucleic acid.

II. Certain Oligomeric Compounds

In certain embodiments, provided herein are oligomeric compounds, which consist of an oligonucleotide (modified or unmodified) and optionally one or more conjugate groups and/or terminal groups. Conjugate groups consist of one or more conjugate moiety and a conjugate linker which links the conjugate moiety to the oligonucleotide. Conjugate groups may be attached to either or both ends of an oligonucleotide and/or at any internal position. In certain embodiments, conjugate groups are attached to the 2'-position of a nucleoside of a modified oligonucleotide. In certain embodiments, conjugate groups that are attached to either or both ends of an oligonucleotide are terminal groups. In certain such embodiments, conjugate groups or terminal groups are attached at the 3' and/or 5'-end of oligonucleotides. In certain such embodiments, conjugate groups (or terminal groups) are attached at the 3'-end of oligonucleotides. In certain embodiments, conjugate groups are attached near the 3'-end of oligonucleotides. In certain embodiments, conjugate groups (or terminal groups) are attached at the 5'-end of oligonucleotides. In certain embodiments, conjugate groups are attached near the 5'-end of oligonucleotides.

Examples of terminal groups include but are not limited to conjugate groups, capping groups, phosphate moieties, protecting groups, modified or unmodified nucleosides, and two or more nucleosides that are independently modified or unmodified.

A. Certain Conjugate Groups

In certain embodiments, oligonucleotides are covalently attached to one or more conjugate groups. In certain embodiments, conjugate groups modify one or more properties of the attached oligonucleotide, including but not limited to pharmacodynamics, pharmacokinetics, stability, binding, absorption, tissue distribution, cellular distribution, cellular uptake, charge and clearance. In certain embodiments, conjugate groups impart a new property on the attached oligonucleotide, e.g., fluorophores or reporter groups that enable detection of the oligonucleotide. Certain conjugate groups and conjugate moieties have been described previously, for example: cholesterol moiety (Letsinger et al., Proc. Natl. Acad. Sci. USA, 1989, 86, 6553-6556), cholic acid (Manoharan et al., *Bioorg. Med. Chem. Lett.*, 1994, 4, 1053-1060), a thioether, e.g., hexyl-S-tritylthiol (Manoharan et al., *Ann. N. Y. Acad. Sci.*, 1992, 660, 306-309; Manoharan et al., *Bioorg. Med. Chem. Lett.*, 1993, 3, 2765-2770), a thiocholesterol (Oberhauser et al., *Nucl. Acids Res.*, 1992, 20, 533-538), an aliphatic chain, e.g., do-decan-diol or undecyl residues (Saison-Behmoaras et al., *EMBO J.*, 1991, 10, 1111-1118; Kabanov et al., *FEBS Lett.*, 1990, 259, 327-330; Svinarchuk et al., *Biochimie*, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., *Tetrahedron Lett.*, 1995, 36, 3651-3654; Shea et al., *Nucl. Acids Res.*, 1990, 18, 3777-3783), a polyamine or a polyethylene glycol chain (Manoharan et al., *Nucleosides & Nucleotides*, 1995, 14, 969-973), or adamantane acetic acid a palmityl moiety (Mishra et al., *Biochim. Biophys. Acta*, 1995, 1264, 229-237), an octadecylamine or hexylamino-carbonyl-oxycholesterol moiety (Crooke et al., *J. Pharmacol. Exp. Ther.*, 1996, 277, 923-937), a tocopherol group (Nishina et al., *Molecular Therapy Nucleic Acids*, 2015, 4, e220; and Nishina et al., *Molecular Therapy*, 2008, 16, 734-740), or a GalNAc cluster (e.g., WO2014/179620).

1. Conjugate Moieties

Conjugate moieties include, without limitation, intercalators, reporter molecules, polyamines, polyamides, peptides, carbohydrates, vitamin moieties, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins, fluorophores, and dyes.

In certain embodiments, a conjugate moiety comprises an active drug substance, for example, aspirin, warfarin, phenylbutazone, ibuprofen, suprofen, fen-bufen, ketoprofen, (S)-(+)-pranoprofen, carprofen, dansylsarcosine, 2,3,5-triiodobenzoic acid, fingolimod, flufenamic acid, folinic acid, a benzothiadiazide, chlorothiazide, a diazepine, indomethicin, a barbiturate, a cephalosporin, a sulfa drug, an antidiabetic, an antibacterial or an antibiotic.

2. Conjugate Linkers

Conjugate moieties are attached to oligonucleotides through conjugate linkers. In certain oligomeric compounds, the conjugate linker is a single chemical bond (i.e., the conjugate moiety is attached directly to an oligonucleotide through a single bond). In certain embodiments, the conjugate linker comprises a chain structure, such as a hydrocarbyl chain, or an oligomer of repeating units such as ethylene glycol, nucleosides, or amino acid units.

In certain embodiments, a conjugate linker comprises one or more groups selected from alkyl, amino, oxo, amide, disulfide, polyethylene glycol, ether, thioether, and hydroxylamino. In certain such embodiments, the conjugate linker comprises groups selected from alkyl, amino, oxo, amide and ether groups. In certain embodiments, the conjugate linker comprises groups selected from alkyl and amide groups. In certain embodiments, the conjugate linker comprises groups selected from alkyl and ether groups. In certain embodiments, the conjugate linker comprises at least one phosphorus moiety. In certain embodiments, the conjugate linker comprises at least one phosphate group. In certain embodiments, the conjugate linker includes at least one neutral linking group.

In certain embodiments, conjugate linkers, including the conjugate linkers described above, are bifunctional linking moieties, e.g., those known in the art to be useful for attaching conjugate groups to parent compounds, such as the oligonucleotides provided herein. In general, a bifunctional linking moiety comprises at least two functional groups. One of the functional groups is selected to bind to a particular site on a parent compound and the other is selected to bind to a conjugate group. Examples of functional groups used in a bifunctional linking moiety include but are not limited to electrophiles for reacting with nucleophilic groups and nucleophiles for reacting with electrophilic groups. In certain embodiments, bifunctional linking moieties comprise one or more groups selected from amino, hydroxyl, carboxylic acid, thiol, alkyl, alkenyl, and alkynyl.

Examples of conjugate linkers include but are not limited to pyrrolidine, 8-amino-3,6-dioxaoctanoic acid (ADO), succinimidyl 4-(N-maleimidomethyl) cyclohexane-1-carboxylate (SMCC) and 6-aminohexanoic acid (AHEX or AHA). Other conjugate linkers include but are not limited to substituted or unsubstituted $C_1$-$C_{10}$ alkyl, substituted or unsubstituted $C_2$-$C_{10}$ alkenyl or substituted or unsubstituted $C_2$-$C_{10}$ alkynyl, wherein a nonlimiting list of preferred substituent groups includes hydroxyl, amino, alkoxy, carboxy, benzyl, phenyl, nitro, thiol, thioalkoxy, halogen, alkyl, aryl, alkenyl and alkynyl.

In certain embodiments, conjugate linkers comprise 1-10 linker-nucleosides. In certain embodiments, conjugate linkers comprise 2-5 linker-nucleosides. In certain embodiments, conjugate linkers comprise exactly 3 linker-nucleosides. In certain embodiments, conjugate linkers comprise the TCA motif. In certain embodiments, such linker-nucleosides are modified nucleosides. In certain embodiments such linker-nucleosides comprise a modified sugar moiety. In certain embodiments, linker-nucleosides are unmodified. In certain embodiments, linker-nucleosides comprise an optionally protected heterocyclic base selected from a purine, substituted purine, pyrimidine or substituted pyrimidine. In certain embodiments, a cleavable moiety is a nucleoside selected from uracil, thymine, cytosine, 4-N-benzoylcytosine, 5-methyl cytosine, 4-N-benzoyl-5-methyl cytosine, adenine, 6-N-benzoyladenine, guanine and 2-N-isobutyrylguanine. It is typically desirable for linker-nucleosides to be cleaved from the oligomeric compound after it reaches a target tissue. Accordingly, linker-nucleosides are typically linked to one another and to the remainder of the oligomeric compound through cleavable bonds. In certain embodiments, such cleavable bonds are phosphodiester bonds.

Herein, linker-nucleosides are not considered to be part of the oligonucleotide. Accordingly, in embodiments in which an oligomeric compound comprises an oligonucleotide consisting of a specified number or range of linked nucleosides and/or a specified percent complementarity to a reference nucleic acid and the oligomeric compound also comprises a conjugate group comprising a conjugate linker comprising linker-nucleosides, those linker-nucleosides are not counted toward the length of the oligonucleotide and are not used in determining the percent complementarity of the oligonucleotide for the reference nucleic acid. For example, an oligomeric compound may comprise (1) a modified oligonucleotide consisting of 8-30 nucleosides and (2) a conjugate group comprising 1-10 linker-nucleosides that are contiguous with the nucleosides of the modified oligonucleotide. The total number of contiguous linked nucleosides in such an oligomeric compound is more than 30. Alternatively, an oligomeric compound may comprise a modified oligonucleotide consisting of 8-30 nucleosides and no conjugate group. The total number of contiguous linked nucleosides in such an oligomeric compound is no more than 30. Unless otherwise indicated conjugate linkers comprise no more than 10 linker-nucleosides. In certain embodiments, conjugate linkers comprise no more than 5 linker-nucleosides. In certain embodiments, conjugate linkers comprise no more than 3 linker-nucleosides. In certain embodiments, conjugate linkers comprise no more than 2 linker-nucleosides. In certain embodiments, conjugate linkers comprise no more than 1 linker-nucleoside.

In certain embodiments, it is desirable for a conjugate group to be cleaved from the oligonucleotide. For example, in certain circumstances oligomeric compounds comprising a particular conjugate moiety are better taken up by a particular cell type, but once the oligomeric compound has been taken up, it is desirable that the conjugate group be cleaved to release the unconjugated or parent oligonucleotide. Thus, certain conjugate linkers may comprise one or more cleavable moieties. In certain embodiments, a cleavable moiety is a cleavable bond. In certain embodiments, a cleavable moiety is a group of atoms comprising at least one cleavable bond. In certain embodiments, a cleavable moiety comprises a group of atoms having one, two, three, four, or more than four cleavable bonds. In certain embodiments, a cleavable moiety is selectively cleaved inside a cell or subcellular compartment, such as a lysosome. In certain embodiments, a cleavable moiety is selectively cleaved by endogenous enzymes, such as nucleases.

In certain embodiments, a cleavable bond is selected from among: an amide, an ester, an ether, one or both esters of a phosphodiester, a phosphate ester, a carbamate, or a disulfide. In certain embodiments, a cleavable bond is one or both of the esters of a phosphodiester. In certain embodiments, a cleavable moiety comprises a phosphate or phosphodiester. In certain embodiments, the cleavable moiety is a phosphate linkage between an oligonucleotide and a conjugate moiety or conjugate group.

In certain embodiments, a cleavable moiety comprises or consists of one or more linker-nucleosides. In certain such embodiments, the one or more linker-nucleosides are linked to one another and/or to the remainder of the oligomeric compound through cleavable bonds. In certain embodiments, such cleavable bonds are unmodified phosphodiester bonds. In certain embodiments, a cleavable moiety is 2'-deoxy nucleoside that is attached to either the 3' or 5'-terminal nucleoside of an oligonucleotide by a phosphate internucleoside linkage and covalently attached to the remainder of the conjugate linker or conjugate moiety by a phosphate or phosphorothioate linkage. In certain such embodiments, the cleavable moiety is 2'-deoxyadenosine.

B. Certain Terminal Groups

In certain embodiments, oligomeric compounds comprise one or more terminal groups. In certain such embodiments, oligomeric compounds comprise a stabilized 5'-phophate. Stabilized 5'-phosphates include, but are not limited to 5'-phosphanates, including, but not limited to 5'-vinylphosphonates. In certain embodiments, terminal groups comprise one or more abasic nucleosides and/or inverted nucleosides. In certain embodiments, terminal groups comprise one or more 2'-linked nucleosides. In certain such embodiments, the 2'-linked nucleoside is an abasic nucleoside.

III. Oligomeric Duplexes

In certain embodiments, oligomeric compounds described herein comprise an oligonucleotide, having a nucleobase sequence complementary to that of a target nucleic acid. In certain embodiments, an oligomeric compound is paired with a second oligomeric compound to form an oligomeric duplex. Such oligomeric duplexes comprise a first oligomeric compound having a region complementary to a target nucleic acid and a second oligomeric compound having a region complementary to the first oligomeric compound. In certain embodiments, the first oligomeric compound of an oligomeric duplex comprises or consists of (1) a modified or unmodified oligonucleotide and optionally a conjugate group and (2) a second modified or unmodified oligonucleotide and optionally a conjugate group. Either or both oligomeric compounds of an oligomeric duplex may comprise a conjugate group. The oligonucleotides of each oligomeric compound of an oligomeric duplex may include non-complementary overhanging nucleosides.

IV. Antisense Activity

In certain embodiments, oligomeric compounds and oligomeric duplexes are capable of hybridizing to a target nucleic acid, resulting in at least one antisense activity; such oligomeric compounds and oligomeric duplexes are antisense compounds. In certain embodiments, antisense compounds have antisense activity when they reduce or inhibit the amount or activity of a target nucleic acid by 25% or more in the standard cell assay. In certain embodiments, antisense compounds selectively affect one or more target nucleic acid. Such antisense compounds comprise a nucleobase sequence that hybridizes to one or more target nucleic acid, resulting in one or more desired antisense activity and does not hybridize to one or more non-target nucleic acid or does not hybridize to one or more non-target nucleic acid in such a way that results in significant undesired antisense activity.

In certain antisense activities, hybridization of an antisense compound to a target nucleic acid results in recruitment of a protein that cleaves the target nucleic acid. For example, certain antisense compounds result in RNase H mediated cleavage of the target nucleic acid. RNase H is a cellular endonuclease that cleaves the RNA strand of an RNA:DNA duplex. The DNA in such an RNA:DNA duplex need not be unmodified DNA. In certain embodiments, described herein are antisense compounds that are sufficiently "DNA-like" to elicit RNase H activity. In certain embodiments, one or more non-DNA-like nucleoside in the gap of a gapmer is tolerated.

In certain antisense activities, an antisense compound or a portion of an antisense compound is loaded into an RNA-induced silencing complex (RISC), ultimately resulting in cleavage of the target nucleic acid. For example, certain antisense compounds result in cleavage of the target nucleic acid by Argonaute. Antisense compounds that are loaded into RISC are RNAi compounds. RNAi compounds may be double-stranded (siRNA) or single-stranded (ssRNA).

In certain embodiments, hybridization of an antisense compound to a target nucleic acid does not result in recruitment of a protein that cleaves that target nucleic acid. In certain embodiments, hybridization of the antisense compound to the target nucleic acid results in alteration of splicing of the target nucleic acid. In certain embodiments, hybridization of an antisense compound to a target nucleic acid results in inhibition of a binding interaction between the target nucleic acid and a protein or other nucleic acid. In certain embodiments, hybridization of an antisense compound to a target nucleic acid results in alteration of translation of the target nucleic acid.

Antisense activities may be observed directly or indirectly. In certain embodiments, observation or detection of an antisense activity involves observation or detection of a change in an amount of a target nucleic acid or protein encoded by such target nucleic acid, a change in the ratio of splice variants of a nucleic acid or protein and/or a phenotypic change in a cell or animal.

V. Certain Target Nucleic Acids

In certain embodiments, oligomeric compounds comprise or consist of an oligonucleotide comprising a region that is complementary to a target nucleic acid. In certain embodiments, the target nucleic acid is an endogenous RNA molecule. In certain embodiments, the target nucleic acid encodes a protein. In certain such embodiments, the target nucleic acid is selected from: a mature mRNA and a pre-mRNA, including intronic, exonic and untranslated regions. In certain embodiments, the target RNA is a mature mRNA. In certain embodiments, the target nucleic acid is a pre-mRNA. In certain such embodiments, the target region is entirely within an intron. In certain embodiments, the target region spans an intron/exon junction. In certain embodiments, the target region is at least 50% within an intron. In certain embodiments, the target nucleic acid is the RNA transcriptional product of a retrogene. In certain embodiments, the target nucleic acid is a non-coding RNA. In certain such embodiments, the target non-coding RNA is selected from: a long non-coding RNA, a short non-coding RNA, an intronic RNA molecule.

A. Complementarity/Mismatches to the Target Nucleic Acid

It is possible to introduce mismatch bases without eliminating activity. For example, Gautschi et al (J. Natl. Cancer Inst. 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo. Maher and Dolnick (Nuc. Acid. Res. 16:3341-3358, 1988) tested a series of tandem 14 nucleobase oligonucleotides, and a 28 and 42 nucleobase oligonucleotides comprised of the sequence of two or three of the tandem oligonucleotides, respectively, for their ability to arrest translation of human DHFR in a rabbit reticulocyte assay. Each of the three 14 nucleobase oligonucleotides alone was able to inhibit translation, albeit at a more modest level than the 28 or 42 nucleobase oligonucleotides.

In certain embodiments, oligonucleotides are complementary to the target nucleic acid over the entire length of the oligonucleotide. In certain embodiments, oligonucleotides are 99%, 95%, 90%, 85%, or 80% complementary to the target nucleic acid. In certain embodiments, oligonucleotides are at least 80% complementary to the target nucleic acid over the entire length of the oligonucleotide and comprise a region that is 100% or fully complementary to a target nucleic acid. In certain embodiments, the region of full complementarity is from 6 to 20, 10 to 18, or 18 to 20 nucleobases in length.

In certain embodiments, oligonucleotides comprise one or more mismatched nucleobases relative to the target nucleic acid. In certain embodiments, antisense activity against the target is reduced by such mismatch, but activity against a non-target is reduced by a greater amount. Thus, in certain embodiments selectivity of the oligonucleotide is improved. In certain embodiments, the mismatch is specifically positioned within an oligonucleotide having a gapmer motif. In certain embodiments, the mismatch is at position 1, 2, 3, 4, 5, 6, 7, or 8 from the 5'-end of the gap region. In certain embodiments, the mismatch is at position 9, 8, 7, 6, 5, 4, 3, 2, 1 from the 3'-end of the gap region. In certain embodiments, the mismatch is at position 1, 2, 3, or 4 from the 5'-end of the wing region. In certain embodiments, the mismatch is at position 4, 3, 2, or 1 from the 3'-end of the wing region.

B. LRRK2

In certain embodiments, oligomeric compounds comprise or consist of an oligonucleotide comprising a region that is complementary to a target nucleic acid, wherein the target nucleic acid is LRRK2. In certain embodiments, LRRK2 nucleic acid has the sequence set forth in SEQ ID NO: 1 (GENBANK Accession No: NM_198578.3) and SEQ ID NO: 2 (GENBANK Accession No: NT_029419.11 truncated from nucleotides 2759000 to 2909000).

In certain embodiments, contacting a cell with an oligomeric compound complementary to SEQ ID NO: 1 or SEQ ID NO: 2 reduces the amount of LRRK2 RNA, and in certain embodiments reduces the amount of LRRK2 protein. In certain embodiments, the oligomeric compound consists of a modified oligonucleotide. In certain embodiments, contacting a cell with an oligomeric compound complementary to SEQ ID NO: 1 or SEQ ID NO: 2 ameliorates one or more symptom or hallmark of a neurodegenerative disease. In certain embodiments, the oligomeric compound consists of a modified oligonucleotide. In certain embodiments, the symptom or hallmark is ataxia, neuropathy, and aggregate formation. In certain embodiments, contacting a cell with a modified oligonucleotide complementary to SEQ ID NO: 1 or SEQ ID NO: 2 results in improved motor function, reduced neuropathy, and reduction in number of aggregates. In certain embodiments, the oligomeric compound consists of a modified oligonucleotide C. Certain Target Nucleic Acids in Certain Tissues In certain embodiments, oligomeric compounds comprise or consist of an oligonucleotide comprising a region that is complementary to a target nucleic acid, wherein the target nucleic acid is expressed in a pharmacologically relevant tissue. In certain embodiments, the pharmacologically relevant tissues are the cells and tissues that comprise the central nervous system (CNS). Such tissues include brain tissues, such as, cortex, substantia nigra, striatum, midbrain, and brainstem and spinal cord.

VI. Certain Pharmaceutical Compositions

In certain embodiments, described herein are pharmaceutical compositions comprising one or more oligomeric compounds. In certain embodiments, the one or more oligomeric compounds each consists of a modified oligonucleotide. In certain embodiments, the pharmaceutical composition comprises a pharmaceutically acceptable diluent or carrier. In certain embodiments, a pharmaceutical composition comprises or consists of a sterile saline solution and one or more oligomeric compound. In certain embodiments, the sterile saline is pharmaceutical grade saline. In certain embodiments, a pharmaceutical composition comprises or consists of one or more oligomeric compound and sterile water. In certain embodiments, the sterile water is pharmaceutical grade water. In certain embodiments, a pharmaceutical composition comprises or consists of one or more oligomeric compound and phosphate-buffered saline (PBS). In certain embodiments, the sterile PBS is pharmaceutical grade PBS. In certain embodiments, a pharmaceutical composition comprises or consists of one or more oligomeric compound and artificial cerebrospinal fluid. In certain embodiments, the artificial cerebrospinal fluid is pharmaceutical grade.

In certain embodiments, a pharmaceutical composition comprises a modified oligonucleotide and artificial cerebrospinal fluid. In certain embodiments, a pharmaceutical composition consists of a modified oligonucleotide and artificial cerebrospinal fluid. In certain embodiments, a pharmaceutical composition consists essentially of a modified oligonucleotide and artificial cerebrospinal fluid. In certain embodiments, the artificial cerebrospinal fluid is pharmaceutical grade.

In certain embodiments, pharmaceutical compositions comprise one or more oligomeric compound and one or more excipients. In certain embodiments, excipients are selected from water, salt solutions, alcohol, polyethylene glycols, gelatin, lactose, amylase, magnesium stearate, talc, silicic acid, viscous paraffin, hydroxymethylcellulose and polyvinylpyrrolidone.

In certain embodiments, oligomeric compounds may be admixed with pharmaceutically acceptable active and/or inert substances for the preparation of pharmaceutical compositions or formulations. Compositions and methods for the formulation of pharmaceutical compositions depend on a number of criteria, including, but not limited to, route of administration, extent of disease, or dose to be administered.

In certain embodiments, pharmaceutical compositions comprising an oligomeric compound encompass any pharmaceutically acceptable salts of the oligomeric compound, esters of the oligomeric compound, or salts of such esters. In certain embodiments, pharmaceutical compositions comprising oligomeric compounds comprising one or more oligonucleotide, upon administration to an animal, including a human, are capable of providing (directly or indirectly) the biologically active metabolite or residue thereof. Accordingly, for example, the disclosure is also drawn to pharmaceutically acceptable salts of oligomeric compounds, prodrugs, pharmaceutically acceptable salts of such prodrugs, and other bioequivalents. Suitable pharmaceutically acceptable salts include, but are not limited to, sodium and potassium salts. In certain embodiments, prodrugs comprise one or more conjugate group attached to an oligonucleotide, wherein the conjugate group is cleaved by endogenous nucleases within the body.

Lipid moieties have been used in nucleic acid therapies in a variety of methods. In certain such methods, the nucleic acid, such as an oligomeric compound, is introduced into preformed liposomes or lipoplexes made of mixtures of cationic lipids and neutral lipids. In certain methods, DNA complexes with mono- or poly-cationic lipids are formed without the presence of a neutral lipid. In certain embodiments, a lipid moiety is selected to increase distribution of a pharmaceutical agent to a particular cell or tissue. In certain embodiments, a lipid moiety is selected to increase distribution of a pharmaceutical agent to fat tissue. In certain embodiments, a lipid moiety is selected to increase distribution of a pharmaceutical agent to muscle tissue.

In certain embodiments, pharmaceutical compositions comprise a delivery system. Examples of delivery systems include, but are not limited to, liposomes and emulsions. Certain delivery systems are useful for preparing certain pharmaceutical compositions including those comprising hydrophobic compounds. In certain embodiments, certain organic solvents such as dimethylsulfoxide are used.

In certain embodiments, pharmaceutical compositions comprise one or more tissue-specific delivery molecules designed to deliver the one or more pharmaceutical agents of the present invention to specific tissues or cell types. For example, in certain embodiments, pharmaceutical compositions include liposomes coated with a tissue-specific antibody.

In certain embodiments, pharmaceutical compositions comprise a co-solvent system. Certain of such co-solvent systems comprise, for example, benzyl alcohol, a nonpolar surfactant, a water-miscible organic polymer, and an aqueous phase. In certain embodiments, such co-solvent systems are used for hydrophobic compounds. A non-limiting example of such a co-solvent system is the VPD co-solvent system, which is a solution of absolute ethanol comprising 3% w/v benzyl alcohol, 8% w/v of the nonpolar surfactant Polysorbate 80™ and 65% w/v polyethylene glycol 300. The proportions of such co-solvent systems may be varied considerably without significantly altering their solubility and toxicity characteristics. Furthermore, the identity of co-solvent components may be varied: for example, other surfactants may be used instead of Polysorbate 80™; the fraction size of polyethylene glycol may be varied; other biocompatible polymers may replace polyethylene glycol, e.g., polyvinyl pyrrolidone; and other sugars or polysaccharides may substitute for dextrose.

In certain embodiments, pharmaceutical compositions are prepared for oral administration. In certain embodiments, pharmaceutical compositions are prepared for buccal administration. In certain embodiments, a pharmaceutical composition is prepared for administration by injection (e.g., intravenous, subcutaneous, intramuscular, intrathecal (IT), intracerebroventricular (ICV), etc.). In certain of such embodiments, a pharmaceutical composition comprises a carrier and is formulated in aqueous solution, such as water or physiologically compatible buffers such as Hanks's solution, Ringer's solution, or physiological saline buffer. In certain embodiments, other ingredients are included (e.g., ingredients that aid in solubility or serve as preservatives). In certain embodiments, injectable suspensions are prepared using appropriate liquid carriers, suspending agents and the like. Certain pharmaceutical compositions for injection are presented in unit dosage form, e.g., in ampoules or in multi-dose containers. Certain pharmaceutical compositions for injection are suspensions, solutions or emulsions in oily or aqueous vehicles, and may contain formulatory agents such as suspending, stabilizing and/or dispersing agents. Certain solvents suitable for use in pharmaceutical compositions for injection include, but are not limited to, lipophilic solvents and fatty oils, such as sesame oil, synthetic fatty acid esters, such as ethyl oleate or triglycerides, and liposomes.

Under certain conditions, certain compounds disclosed herein act as acids. Although such compounds may be drawn or described in protonated (free acid) form, in ionized (anion) form, or ionized and in association with a cation (salt) form, aqueous solutions of such compounds exist in equilibrium among such forms. For example, a phosphate linkage of an oligonucleotide in aqueous solution exists in equilibrium among free acid, anion, and salt forms. Unless otherwise indicated, compounds described herein are intended to include all such forms. Moreover, certain oligonucleotides have several such linkages, each of which is in equilibrium. Thus, oligonucleotides in solution exist in an ensemble of forms at multiple positions all at equilibrium. The term "oligonucleotide" is intended to include all such forms. Drawn structures necessarily depict a single form. Nevertheless, unless otherwise indicated, such drawings are likewise intended to include corresponding forms. Herein, a structure depicting the free acid of a compound followed by the term "or salts thereof" expressly includes all such forms that may be fully or partially protonated/de-protonated/in association with a cation. In certain instances, one or more specific cation is identified.

In certain embodiments, oligomeric compounds disclosed herein are in aqueous solution with sodium. In certain embodiments, oligomeric compounds are in aqueous solution with potassium. In certain embodiments, oligomeric compounds are in articial CSF. In certain embodiments, oligomeric compounds are in PBS. In certain embodiments, oligomeric compounds are in water. In certain such embodiments, the pH of the solution is adjusted with NaOH and/or HCl to achieve a desired pH.

VII. Certain Compositions

1. Compound No: 780241

Compound No: 780241 may be characterized as a 5-10-5 MOE gapmer having a sequence of (from 5' to 3') GCTCATATCTAAAGACCGCA (incorporated herein as SEQ ID NO: 222), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

Compound No: 780241 may be characterized by the following chemical notation: Ges mCeo Teo mCeo Aes Tds Ads Tds mCds Tds Ads Ads Ads Gds Ads mCeo mCeo Ges mCes Ae (SEQ ID NO: 3849); wherein,
A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Compound No: 780241 may be represented by the following chemical structure:

Structure 1. Compound No: 780241

(SEQ ID NO: 3849)

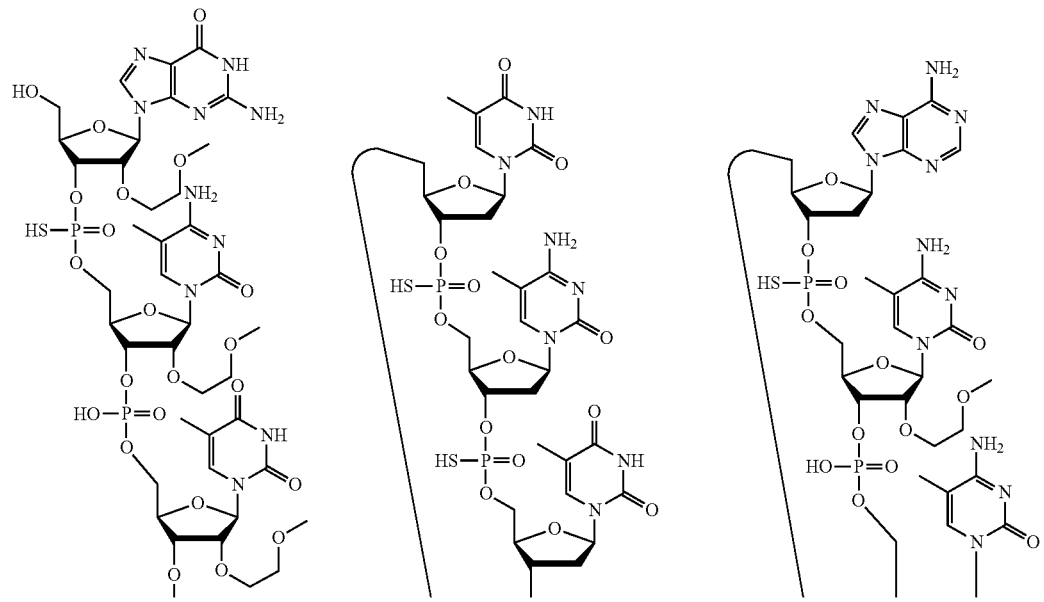

59
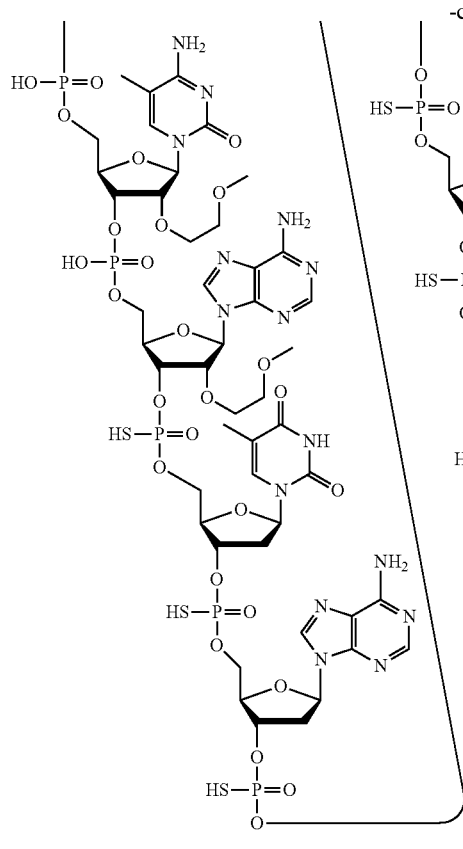
60
-continued
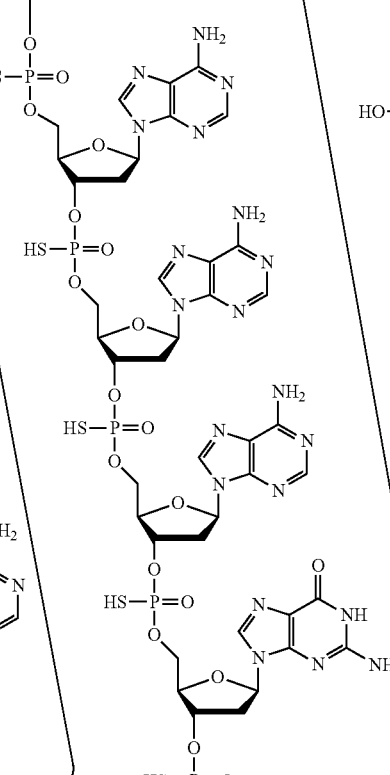
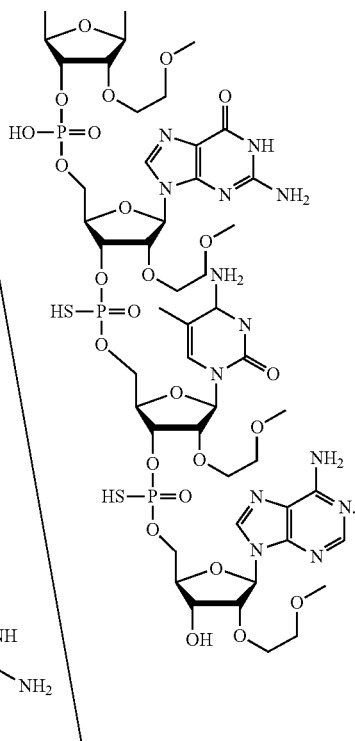
Compound No: 780241 may be represented by the following chemical structure:
Structure 2. The Sodium salt of Compound No: 780241
(SEQ ID NO: 3849)
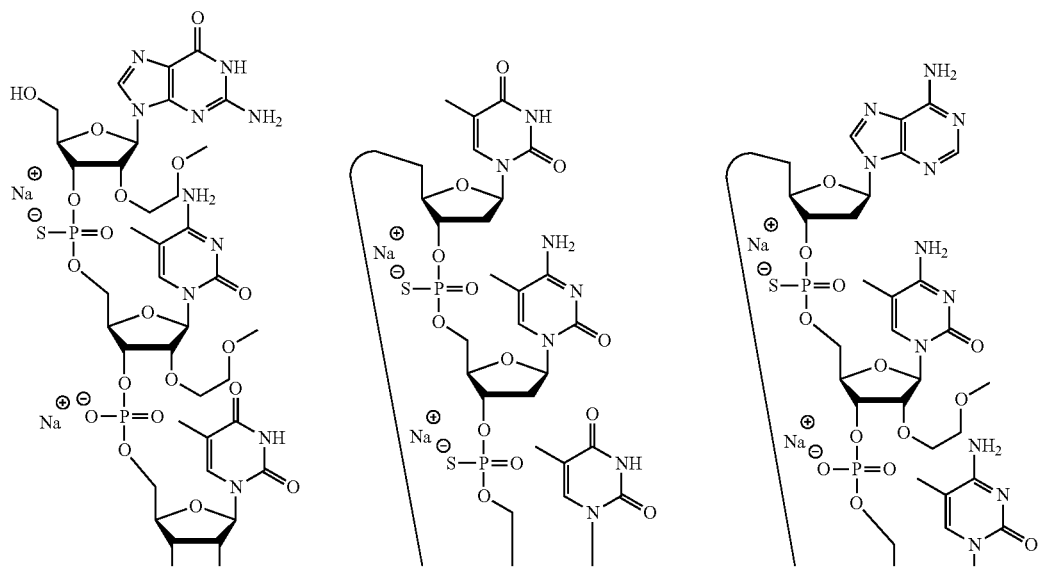

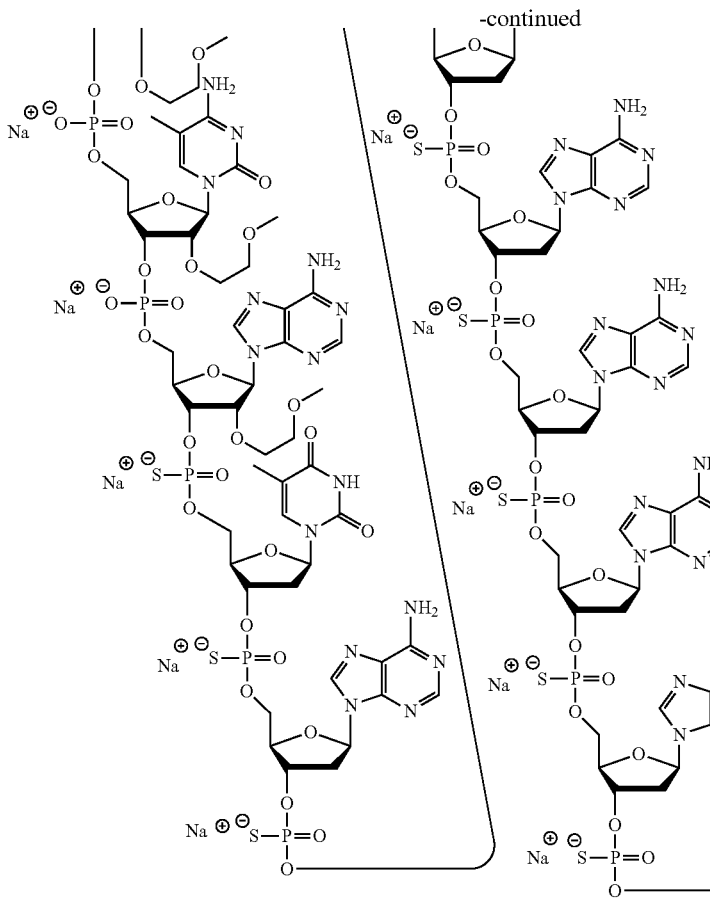
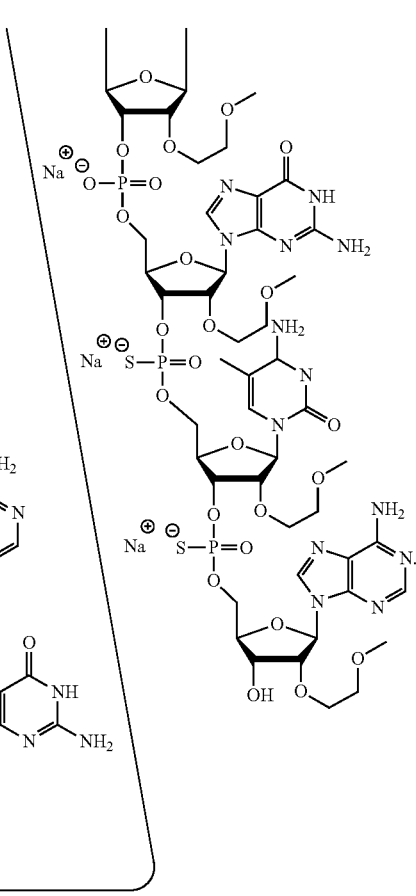

2. Compound No: 802714

Compound No: 802714 may be characterized as a 5-10-5 MOE gapmer, having a sequence of (from 5' to 3') TCAC-CACAAACTCATGGACT (incorporated herein as SEQ ID NO: 888), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

Compound No: 802714 may be characterized by the following chemical notation: Tes mCeo Aeo mCeo mCes Ads mCds Ads Ads Ads mCds Tds mCds Ads Tds Geo Geo Aes mCes Te (SEQ ID NO: 3850); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Compound No: 802714 may be represented by the following chemical structure:
Structure 3. Compound No: 802714
(SEQ ID NO: 3850)
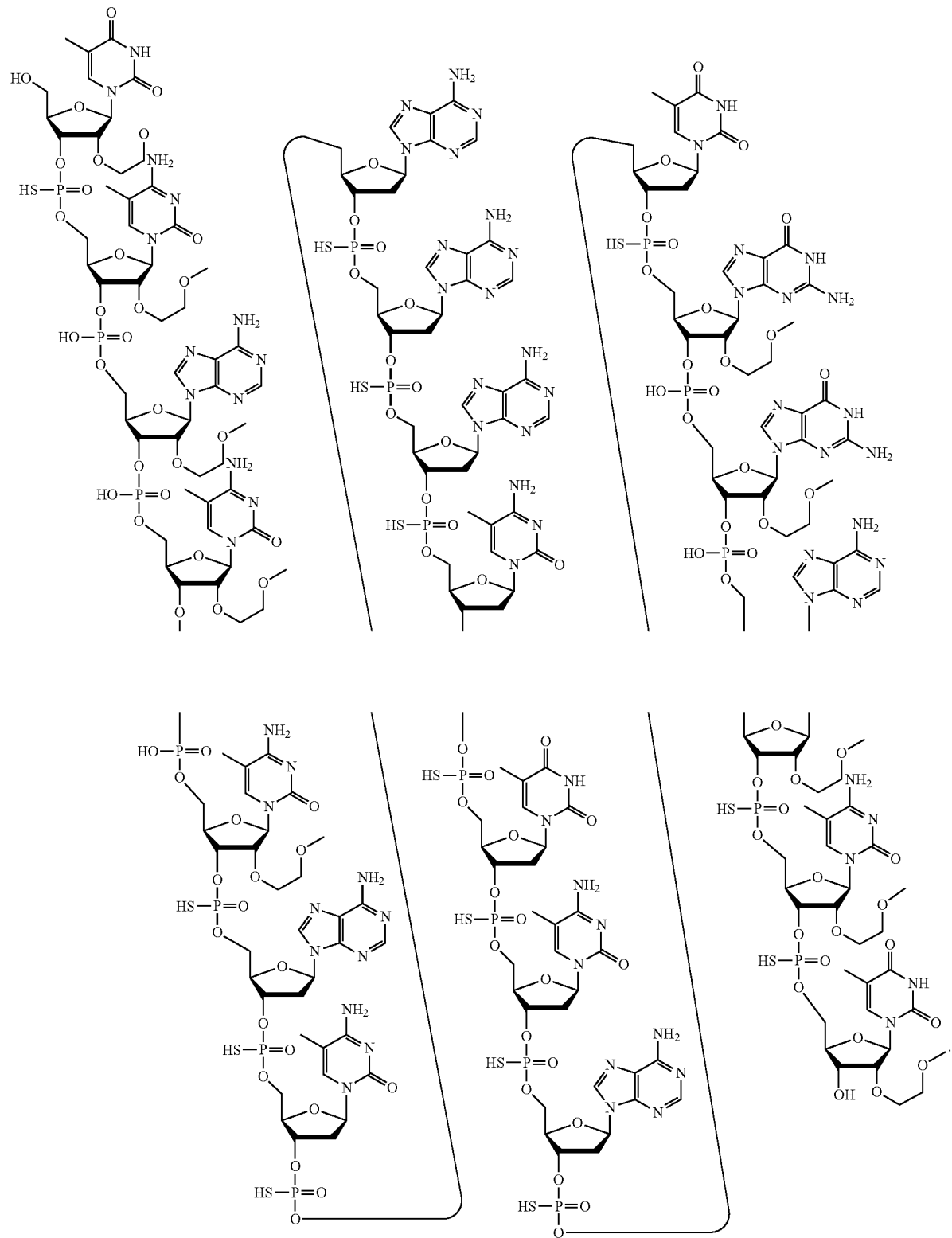

Compound No: 802714 may be represented by the following chemical structure:

Structure 4. The Sodium salt of Compound No: 802714

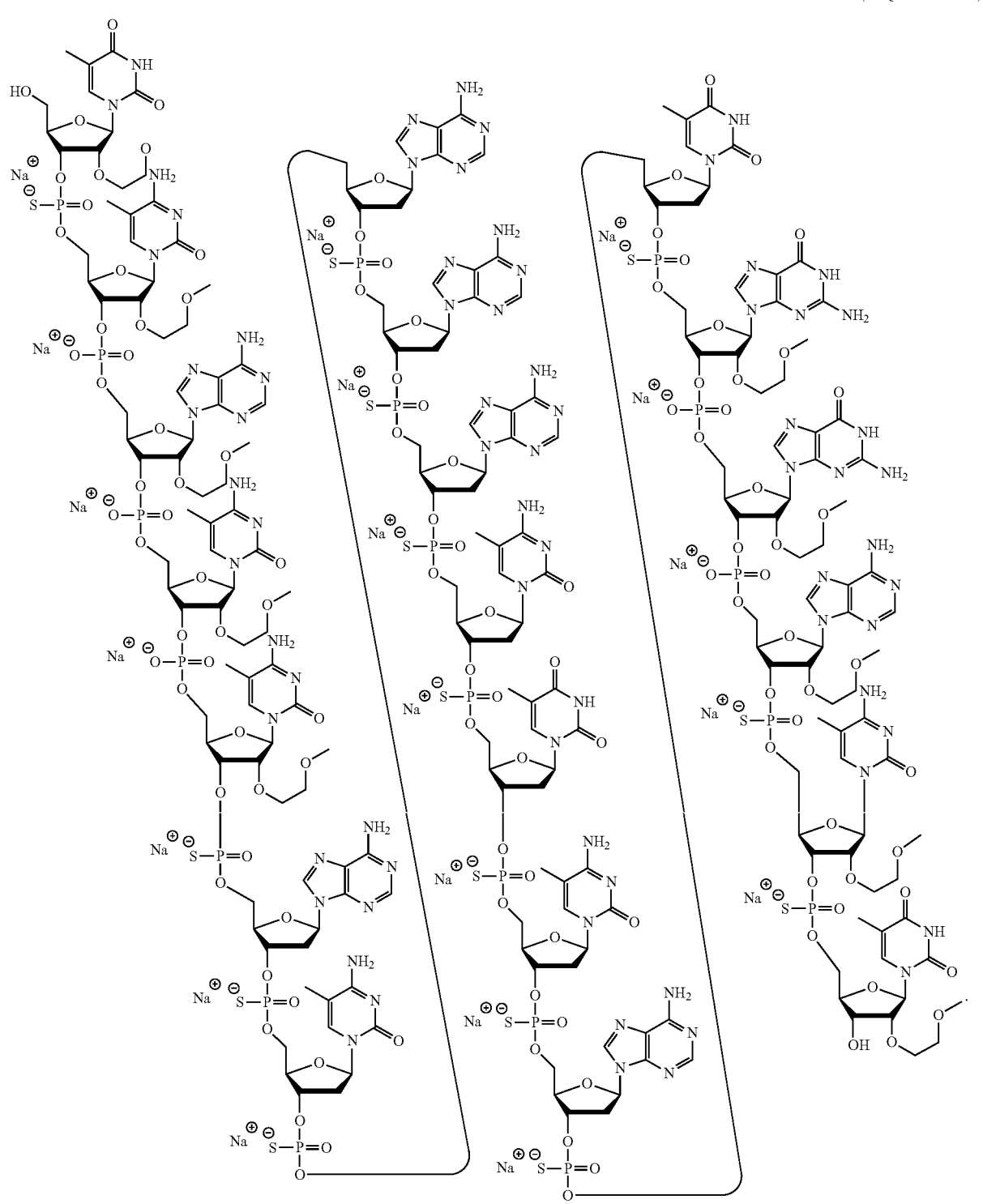

(SEQ ID NO: 3850)

3. Compound No: 803268

Compound No: 803268 may be characterized as a 5-10-5 MOE gapmer, having a sequence of (from 5' to 3') ACCCTTTCCATGTGAACATT (incorporated herein as SEQ TD NO: 1431), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

Compound No: 803268 may be characterized by the following chemical notation: Aes mCeo mCeo mCeo Tes Tds Tds mCds mCds Ads Tds Gds Tds Gds Ads Aeo mCeo Aes Tes Te (SEQ ID NO: 3851); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Compound No: 803268 may be represented by the following chemical structure:

Structure 5. Compound No: 803268

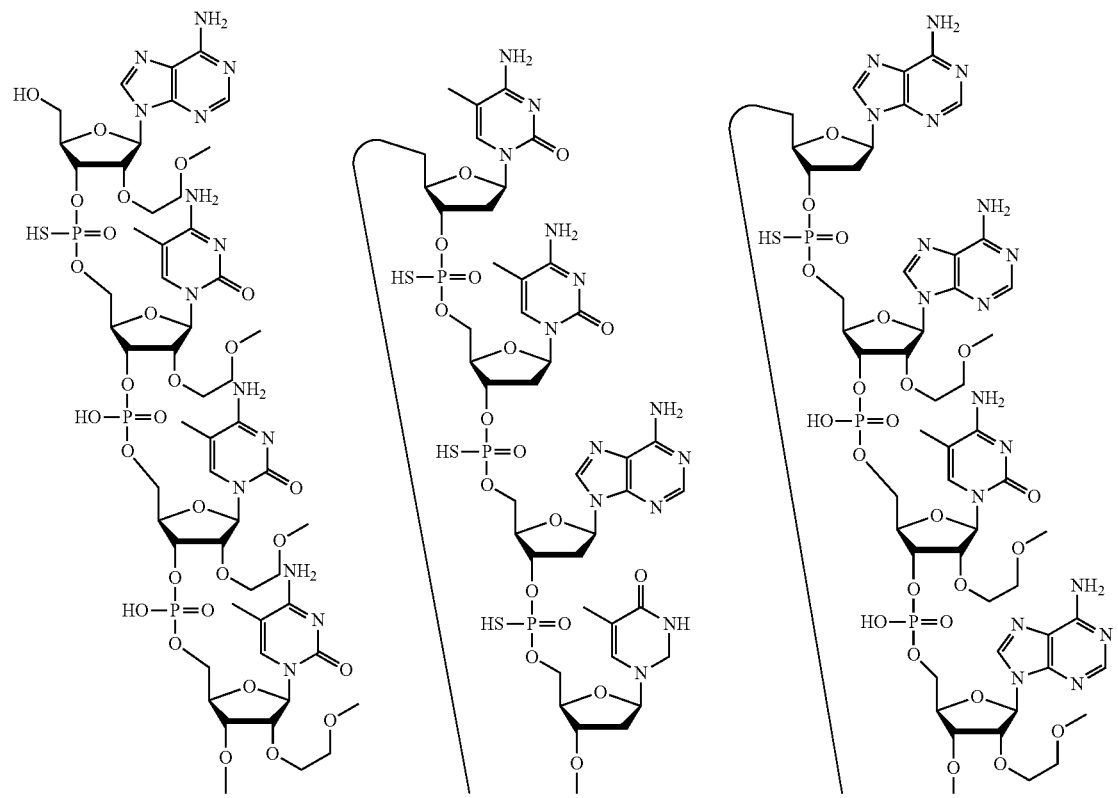

(SEQ ID NO: 3851)

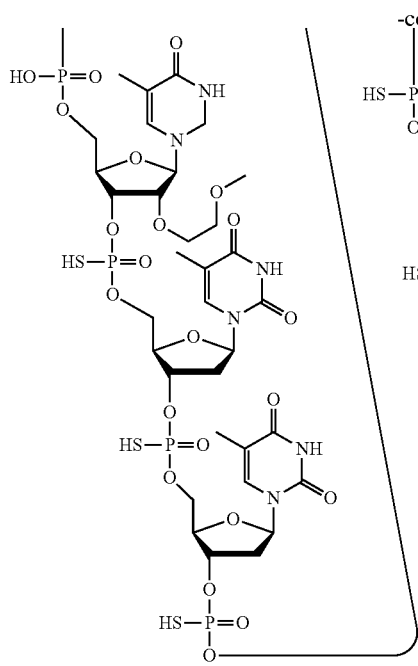
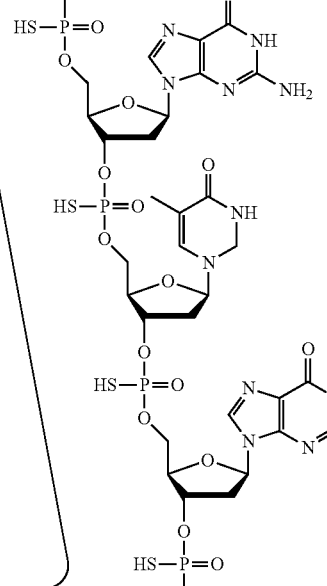
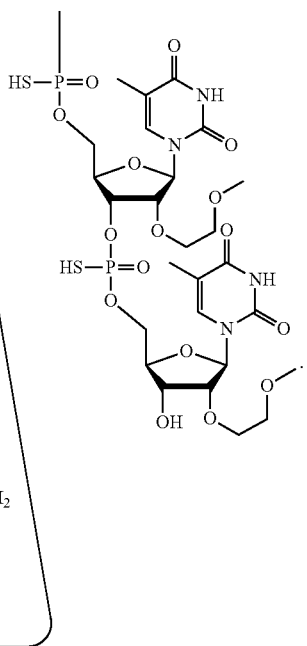
Compound No: 803268 may be represented by the following chemical structure:
Structure 6. The Sodium salt of Compound No: 803268
(SEQ ID NO: 3851)
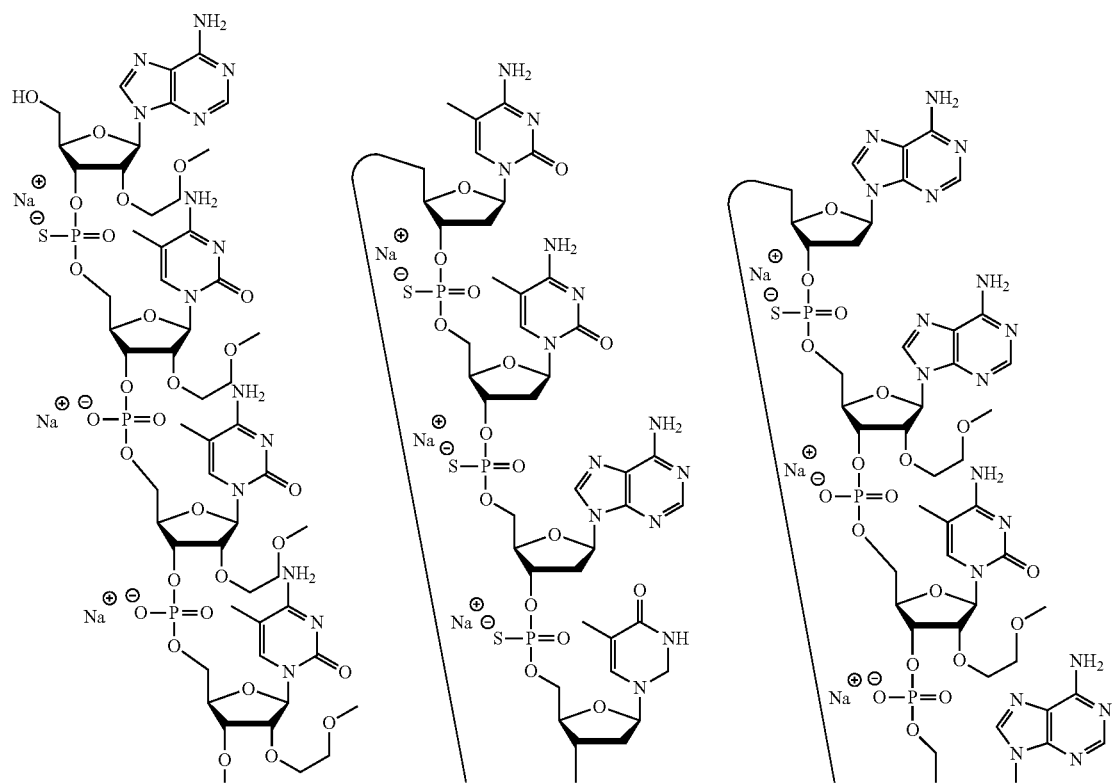

-continued

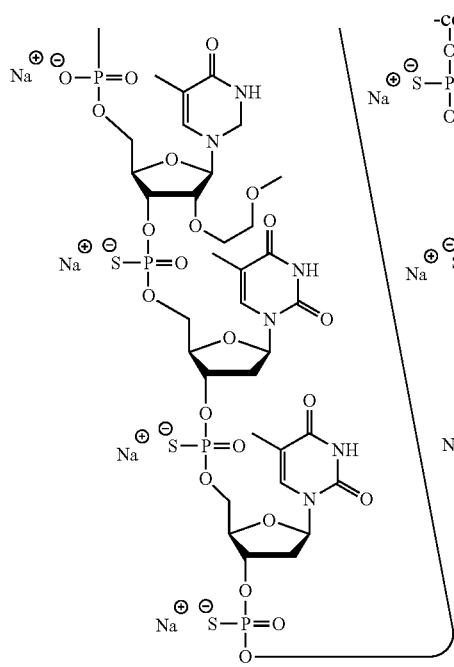
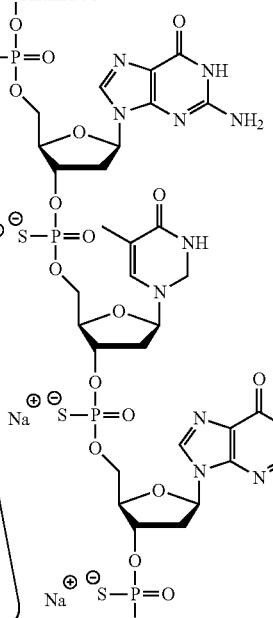
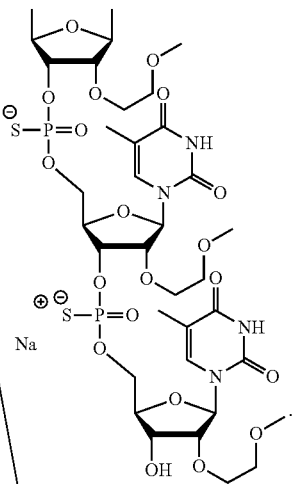

4. Compound No: 876031

Compound No: 876031 may be characterized as a 5-10-5 MOE gapmer, having a sequence of (from 5' to 3') ACGCACTTAACAATATCATA (incorporated herein as SEQ ID NO: 3590), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

Compound No: 876031 may be characterized by the following chemical notation: Aes mCeo Geo mCeo Aes mCds Tds Tds Ads Ads mCds Ads Ads Tds Ads Teo mCeo Aes Tes Ae (SEQ ID NO: 3852); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.-

Compound No: 876031 may be represented by the following chemical structure:
Structure 7. Compound No: 876031
(SEQ ID NO: 3852)
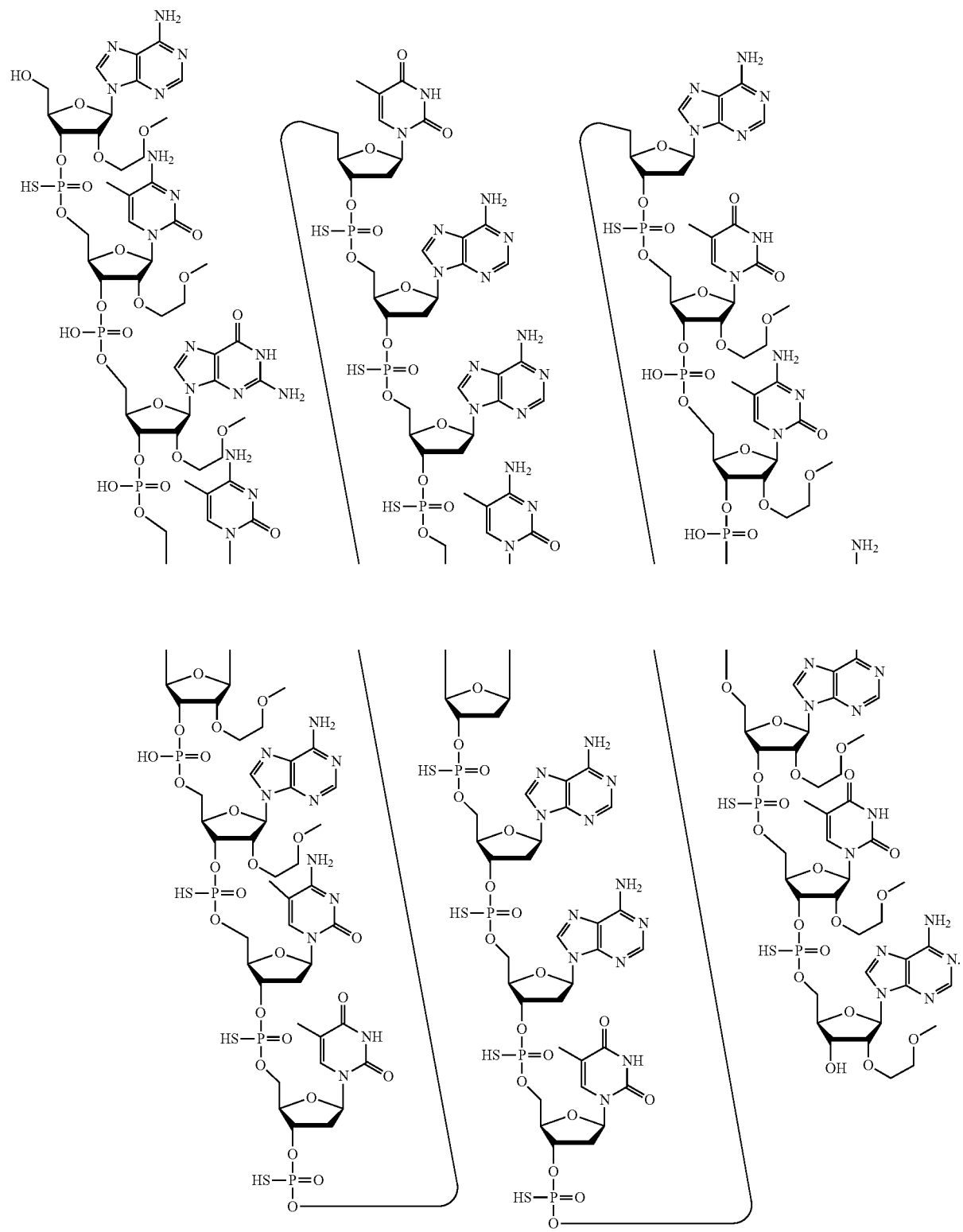

Compound No: 876031 may be represented by the following chemical structure:

Structure 8. The Sodium salt of Compound No: 876031

(SEQ ID NO: 3852)

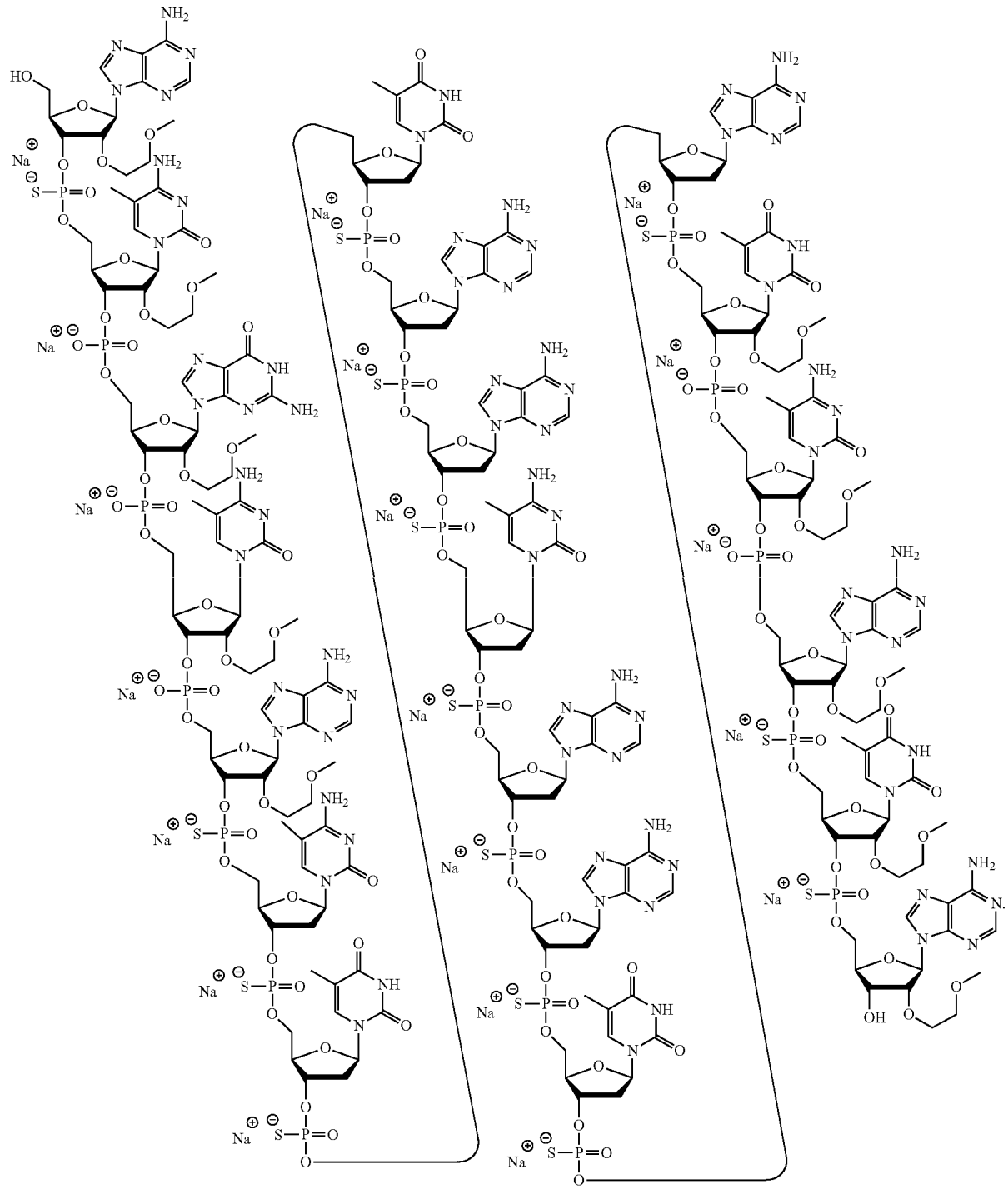

5. Compound No: 876604

Compound No: 876604 may be characterized as a 5-10-5 MOE gapmer, having a sequence of (from 5' to 3') AGCAATCATTGGTAGCATAC (incorporated herein as SEQ ID NO: 3385), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3, 3 to 4, 4 to 5, 16 to 17, and 17 to 18 are phosphodiester internucleoside linkages and the internucleoside linkages between nucleosides 1 to 2, 5 to 6, 6 to 7, 7 to 8, 8 to 9, 9 to 10, 10 to 11, 11 to 12, 12 to 13, 13 to 14, 14 to 15, 15 to 16, 18 to 19, and 19 to 20 are phosphorothioate internucleoside linkages, and wherein each cytosine is a 5-methyl cytosine.

Compound No: 876604 may be characterized by the following chemical notation: Aes Geo mCeo Aeo Aes Tds mCds Ads Tds Tds Gds Gds Tds Ads Gds mCeo Aeo Tes Aes mCe (SEQ ID NO: 3853); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Compound No: 876604 may be represented by the following chemical structure:

Structure 8. Compound No: 876604

(SEQ ID NO: 3853)

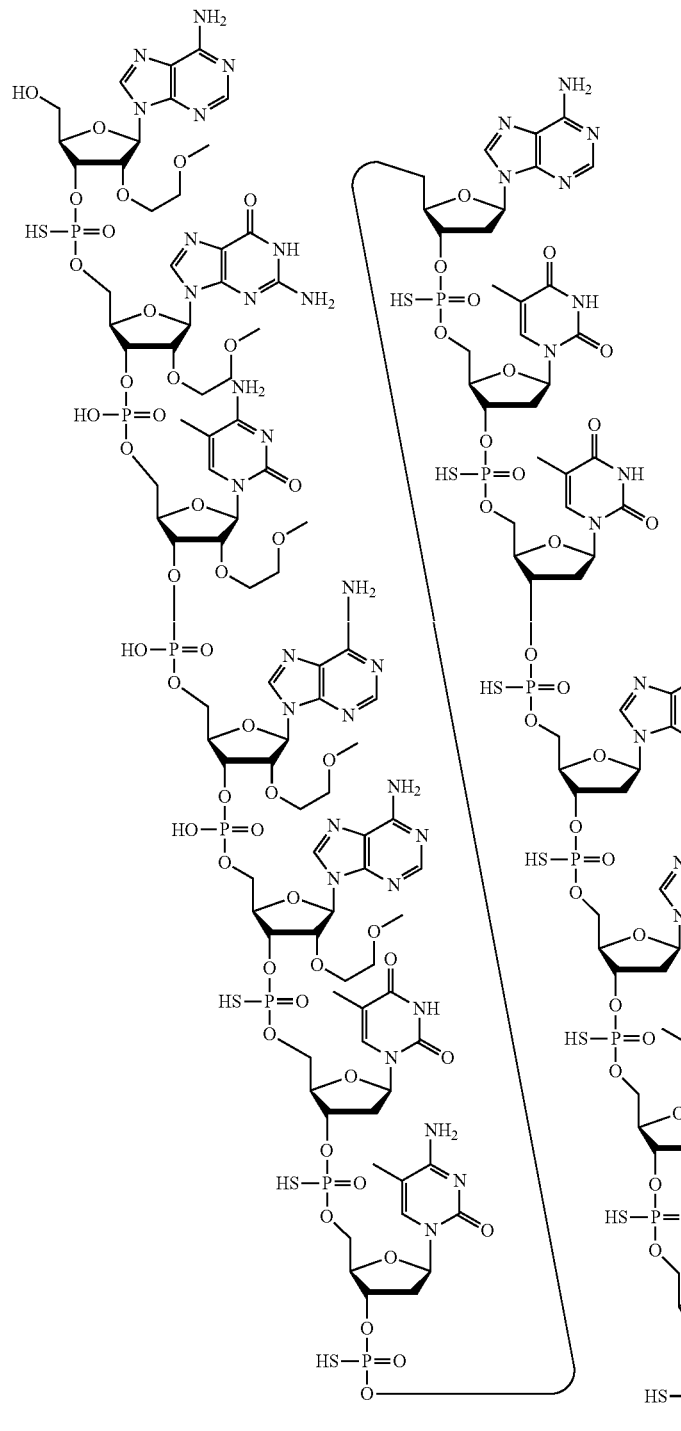
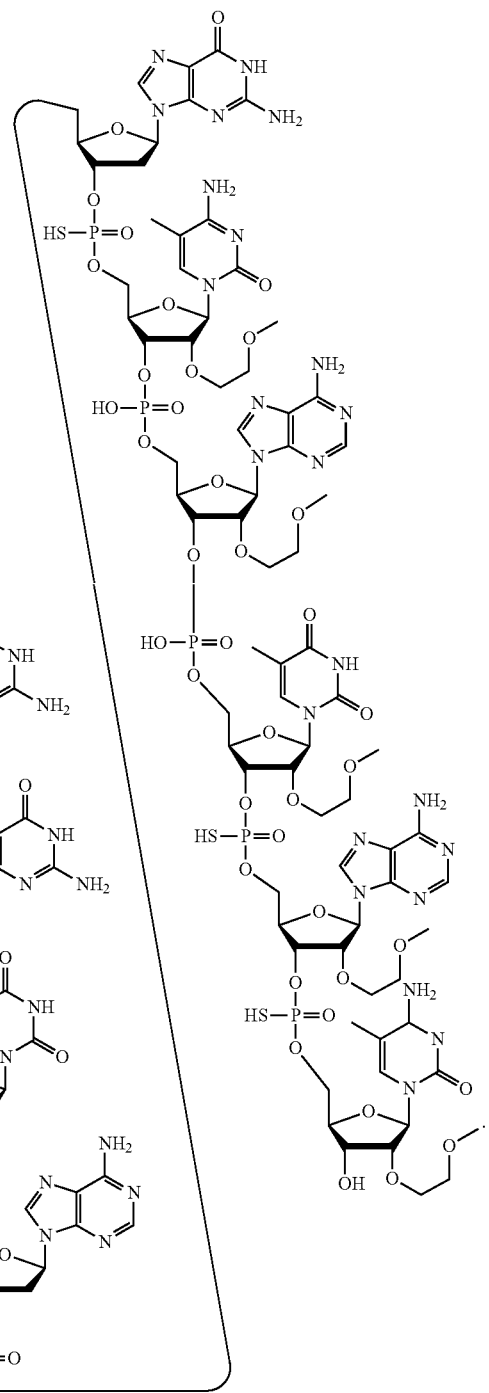

Compound No: 876604 may be represented by the following chemical structure:

Structure 10. The Sodium salt of Compound No: 876604

(SEQ ID NO: 3853)

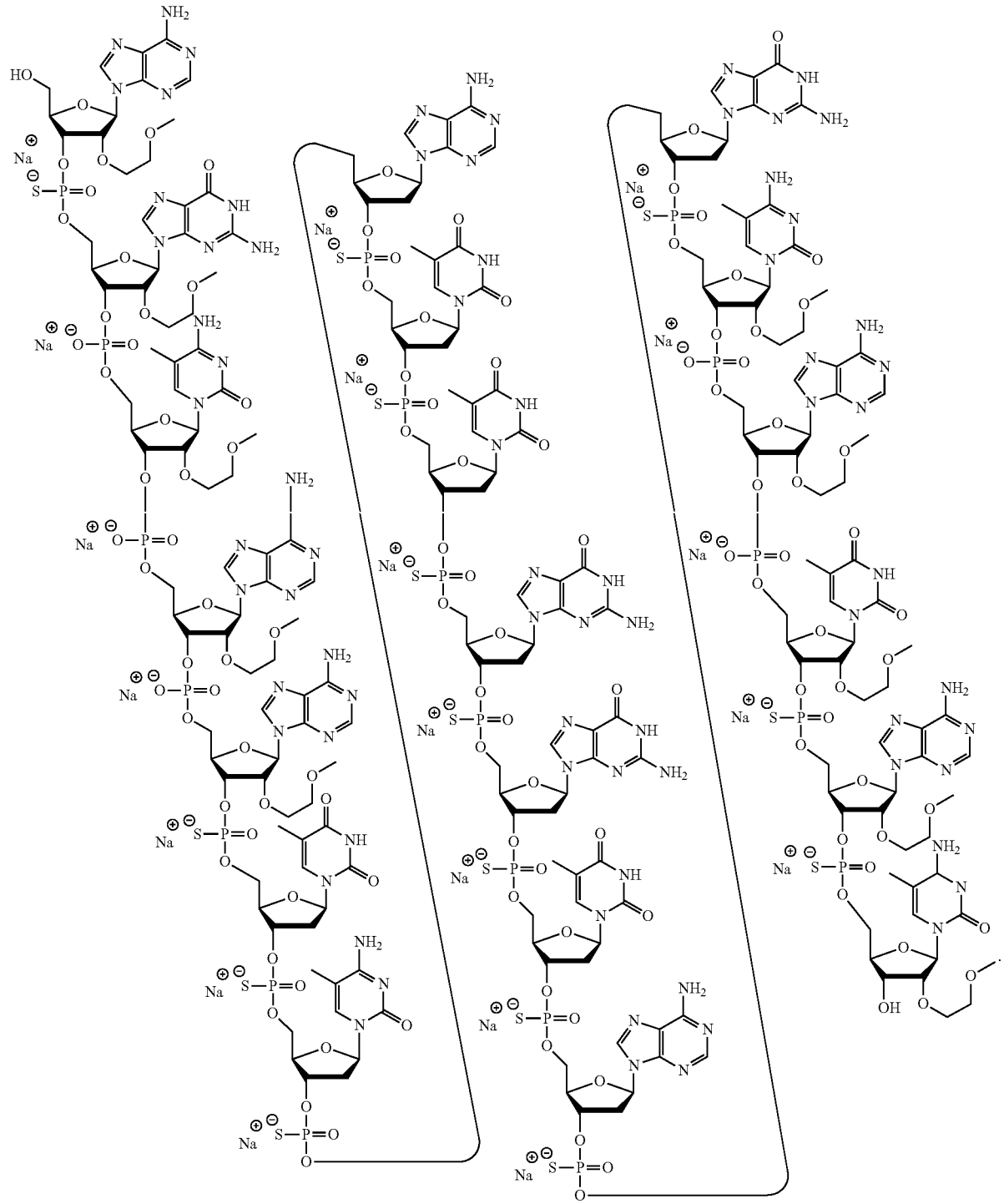

6. Compound No: 934556

Compound No: 934556 may be characterized as a 5-10-5 MOE gapmer, having a sequence of (from 5' to 3') CGCACTTAACAATATCATAT (incorporated herein as SEQ ID NO: 852), wherein each of nucleosides 1-5 and 16-20 (from 5' to 3') comprise a 2'-MOE modification and each of nucleosides 6-15 are 2'-deoxynucleosides, wherein the internucleoside linkages between nucleosides 2 to 3 and 17 to 18 are phosphodiester internucleoside linkages and the internucleoside linkages between nucleosides 1 to 2, 3 to 4, 4 to 5, 5 to 6, 6 to 7, 7 to 8, 8 to 9, 9 to 10, 10 to 11, 11 to 12, 12 to 13, 13 to 14, 14 to 15, 15 to 16, 16 to 17, 18 to 19, and 19 to 20 are phosphorothioate internucleoside linkages, and wherein each cytosine is a 5-methyl cytosine.

Compound No: 934556 may be characterized by the following chemical notation: mCes Geo mCes Aes mCes Tds Tds Ads Ads mCds Ads Ads Tds Ads Tds mCes Aeo Tes Aes Te (SEQ ID NO: 3854); wherein, A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar,
s=a phosphorothioate internucleoside linkage, and
o=a phosphodiester internucleoside linkage.

Compound No: 934556 may be represented by the following chemical structure:

Structure 11. Compound No: 934556

(SEQ ID NO: 3854)

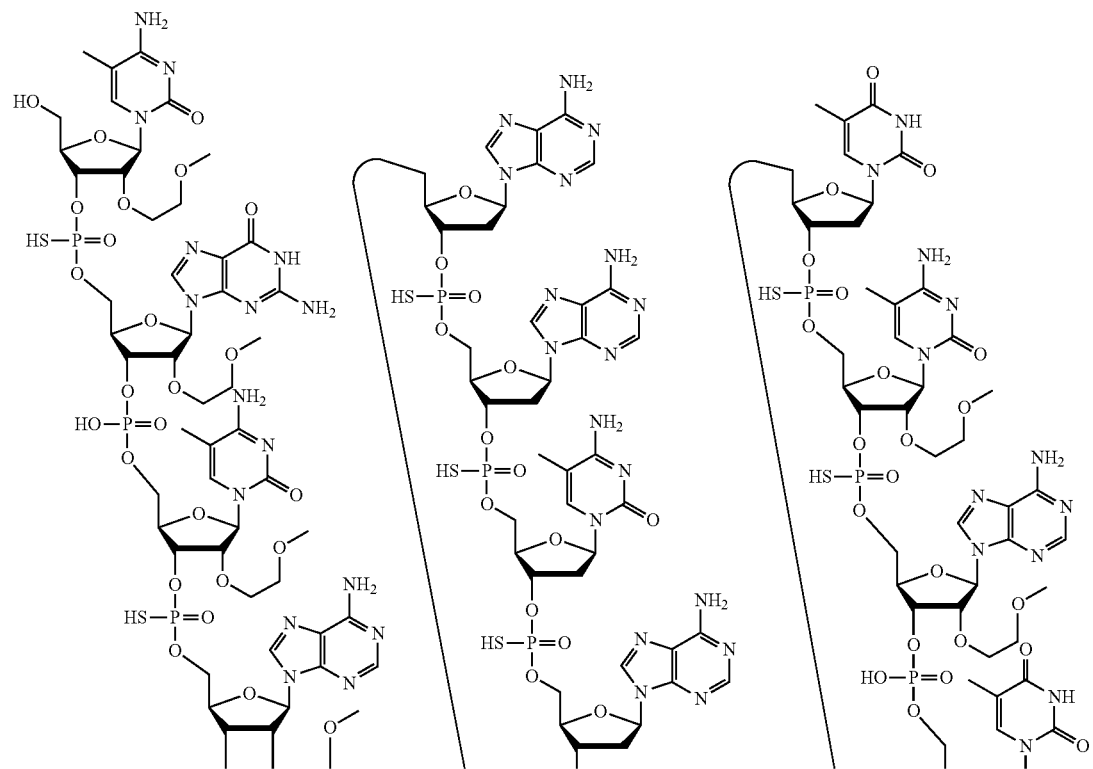

83
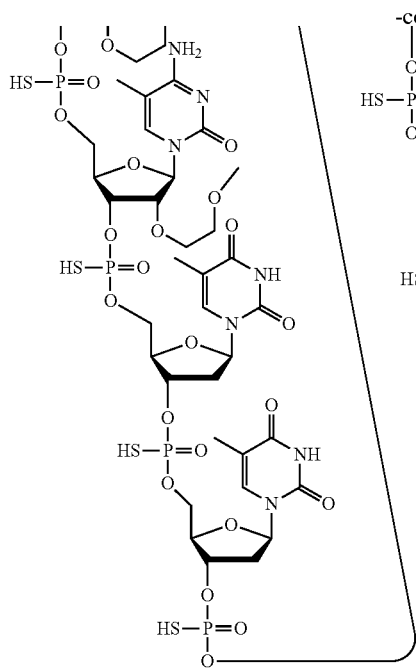
-continued
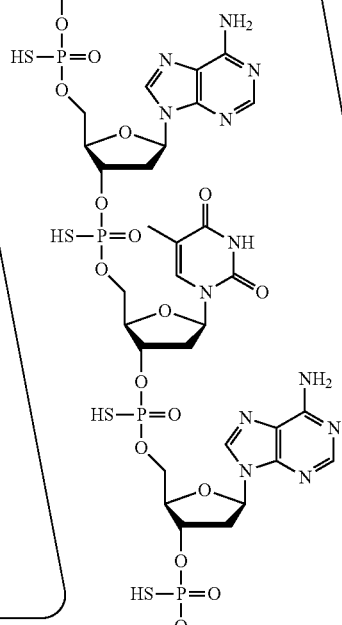
84
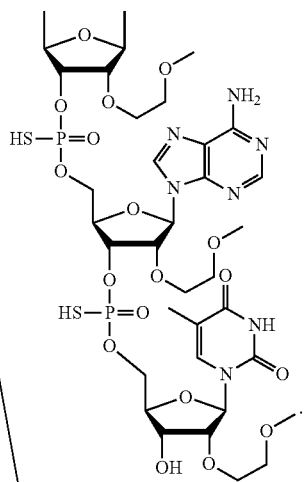
Compound No: 934556 may be represented by the following chemical structure:
Structure 12. The Sodium salt of Compound No: 934556
(SEQ ID NO: 3854)
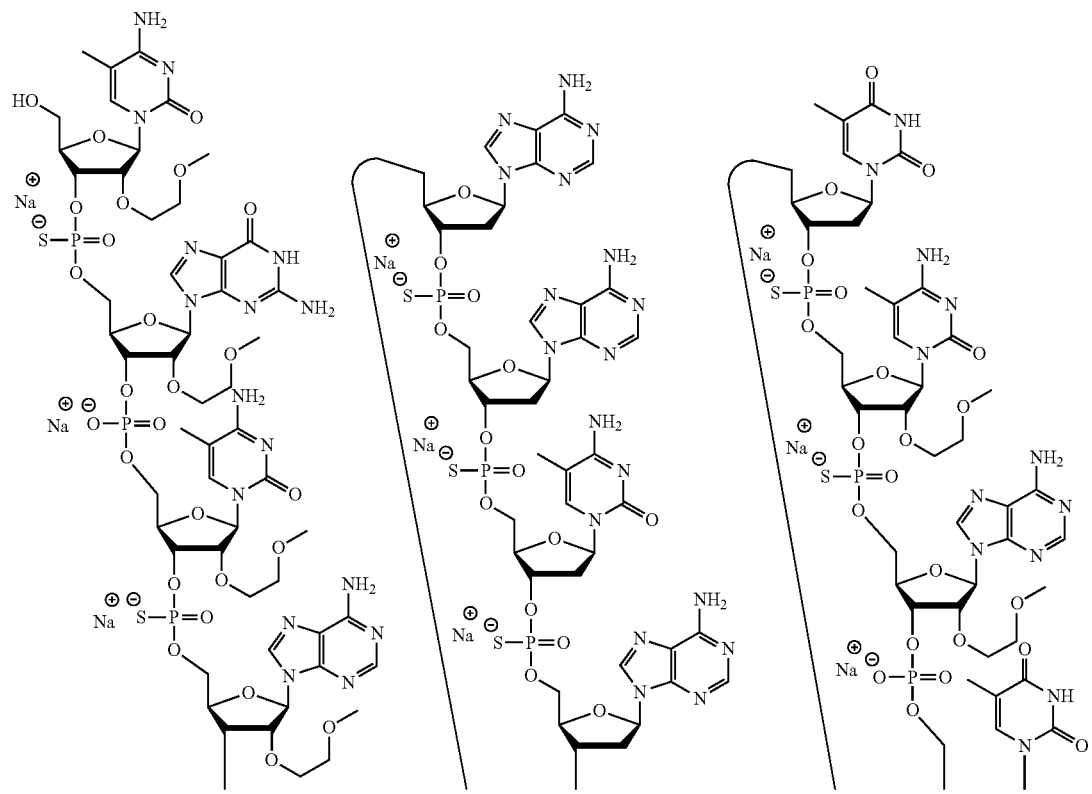

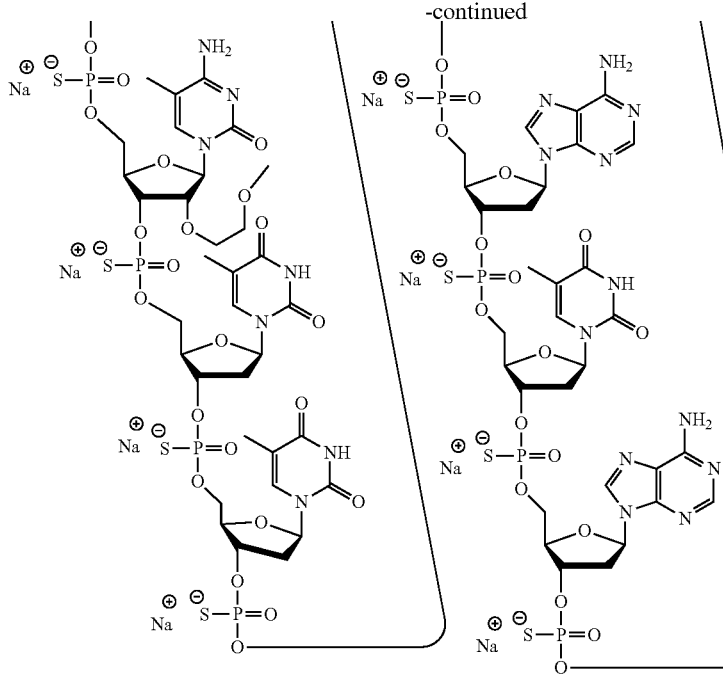
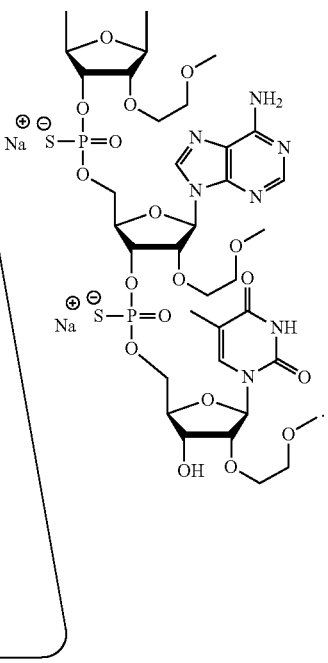

VIII. Certain Hotspot Regions
1. Nucleobases 18,633-18,658 of SEQ ID NO: 2

In certain embodiments, nucleobases 18,633-18,658 of SEQ ID NO: 2 comprise a hotspot region. In certain embodiments, siRNAs are complementary to nucleobases 18,633-18,658 of SEQ ID NO: 2. In certain embodiments, modified oligonucleotides are complementary to nucleobases 18,633-18,658 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 852, 1997, 2073, 2148, 3513, and 3590 are complementary to nucleobases 18,633-18,658 of SEQ ID NO: 2.

In certain embodiments, modified oligonucleotides complementary to nucleobases 18,633-18,658 of SEQ ID NO: 2 achieve at least 54% reduction of LRRK2 RNA in vitro in at least one single dose assay.

2. Nucleobases 21,721-21,755 of SEQ ID NO: 2

In certain embodiments, nucleobases 21,721-21,755 of SEQ ID NO: 2 comprise a hotspot region. In certain embodiments, siRNAs are complementary to nucleobases 21,721-21,755 of SEQ ID NO: 2. In certain embodiments, modified oligonucleotides are complementary to nucleobases 21,721-21,755 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 291, 869, 870, 871, 872, 873, 874, 875, 876, 877, 878, 879, and 880 are complementary to nucleobases 21,721-21,755 of SEQ ID NO: 2.

In certain embodiments, modified oligonucleotides complementary to nucleobases 21,721-21,755 of SEQ ID NO: 2 achieve at least 52% reduction of LRRK2 RNA in vitro in at least one single dose assay.

3. Nucleobases 27,963-28,016 of SEQ ID NO: 2

In certain embodiments, nucleobases 27,963-28,016 of SEQ ID NO: 2 comprise a hotspot region. In certain embodiments, siRNAs are complementary to nucleobases 27,963-28,016 of SEQ ID NO: 2. In certain embodiments, modified oligonucleotides are complementary to nucleobases 27,963-28,016 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 293, 886, 887, 888, 889, 890, 891, 892, 893, and 3745 are complementary to nucleobases 27,963-28,016 of SEQ ID NO: 2.

In certain embodiments, modified oligonucleotides complementary to nucleobases 27,963-28,016 of SEQ ID NO: 2 achieve at least 39% reduction of LRRK2 RNA in vitro in at least one single dose assay.

4. Nucleobases 35,415-35,446 of SEQ ID NO: 2

In certain embodiments, nucleobases 35,415-35,446 of SEQ ID NO: 2 comprise a hotspot region. In certain embodiments, siRNAs are complementary to nucleobases 35,415-35,446 of SEQ ID NO: 2. In certain embodiments, modified oligonucleotides are complementary to nucleobases 35,415-35,446 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 920, 921, 2378, 2454, 2530, 2606, 2683, 2759, 2835, 3061, 3137, 3212, and 3288 are complementary to nucleobases 35,415-35,446 of SEQ ID NO: 2.

In certain embodiments, modified oligonucleotides complementary to nucleobases 35,415-35,446 of SEQ ID NO: 2 achieve at least 42% reduction of LRRK2 RNA in vitro in at least one single dose assay.

5. Nucleobases 77,221-77,264 of SEQ ID NO: 2

In certain embodiments, nucleobases 77,221-77,264 of SEQ ID NO: 2 comprise a hotspot region. In certain embodiments, siRNAs are complementary to nucleobases 77,221-77,264 of SEQ ID NO: 2. In certain embodiments, modified oligonucleotides are complementary to nucleobases 77,221-77,264 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 131, 217, 1106, 1107, and 1108 are complementary to nucleobases 77,221-77,264 of SEQ ID NO: 2.

In certain embodiments, modified oligonucleotides complementary to nucleobases 77,221-77,264 of SEQ ID NO: 2 achieve at least 51% reduction of LRRK2 RNA in vitro in at least one single dose assay.

6. Nucleobases 81,581-81,612 and 87,838-87,869 of SEQ ID NO: 2

In certain embodiments, nucleobases 81,581-81,612 and 87,838-87,869 of SEQ ID NO: 2 comprise a hotspot region. In certain embodiments, siRNAs are complementary to nucleobases 81,581-81,612 and 87,838-87,869 of SEQ ID NO: 2. In certain embodiments, modified oligonucleotides are complementary to nucleobases 81,581-81,612 and 87,838-87,869 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 667, 668, 669, 670, 671, 1785, 1786, 1787, 1788, 1789, 1790, 1791, and 1792 are complementary to nucleobases 81,581-81,612 and 87,838-87,869 of SEQ ID NO: 2.

In certain embodiments, modified oligonucleotides complementary to nucleobases 81,581-81,612 and 87,838-87,869 of SEQ ID NO: 2 achieve at least 38% reduction of LRRK2 RNA in vitro in at least one single dose assay.

7. Nucleobases 81,627-81,651 of SEQ ID NO: 2

In certain embodiments, nucleobases 81,627-81,651 of SEQ ID NO: 2 comprise a hotspot region. In certain embodiments, siRNAs are complementary to nucleobases 81,627-81,651 of SEQ ID NO: 2. In certain embodiments, modified oligonucleotides are complementary to nucleobases 81,627-81,651 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 674, 1799, 1800, 1801, 1802, and 1803 are complementary to nucleobases 81,627-81,651 of SEQ ID NO: 2.

In certain embodiments, modified oligonucleotides complementary to nucleobases 81,627-81,651 of SEQ ID NO: 2 achieve at least 66% reduction of LRRK2 RNA in vitro in at least one single dose assay.

8. Nucleobases 82,058-82,081 of SEQ ID NO: 2

In certain embodiments, nucleobases 82,058-82,081 of SEQ ID NO: 2 comprise a hotspot region. In certain embodiments, siRNAs are complementary to nucleobases 82,058-82,081 of SEQ ID NO: 2. In certain embodiments, modified oligonucleotides are complementary to nucleobases 82,058-82,081 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 222, 1130, 1131, 1132, and 1133 are complementary to nucleobases 82,058-82,081 of SEQ ID NO: 2.

In certain embodiments, modified oligonucleotides complementary to nucleobases 82,058-82,081 of SEQ ID NO: 2 achieve at least 53% reduction of LRRK2 RNA in vitro in at least one single dose assay.

9. Nucleobases 82,180-82,220 of SEQ ID NO: 2

In certain embodiments, nucleobases 82,180-82,220 of SEQ ID NO: 2 comprise a hotspot region. In certain embodiments, siRNAs are complementary to nucleobases 82,180-82,220 of SEQ ID NO: 2. In certain embodiments, modified oligonucleotides are complementary to nucleobases 82,180-82,220 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 225, 1145, 2005, 2840, 3369, 3446, 3521, 3598, and 3674 are complementary to nucleobases 82,180-82,220 of SEQ ID NO: 2.

In certain embodiments, modified oligonucleotides complementary to nucleobases 82,180-82,220 of SEQ ID NO: 2 achieve at least 64% reduction of LRRK2 RNA in vitro in at least one single dose assay.

10. Nucleobases 82,500-82,525 of SEQ ID NO: 2

In certain embodiments, nucleobases 82,500-82,525 of SEQ ID NO: 2 comprise a hotspot region. In certain embodiments, siRNAs are complementary to nucleobases 82,500-82,525 of SEQ ID NO: 2. In certain embodiments, modified oligonucleotides are complementary to nucleobases 82,500-82,525 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssssooss.

The nucleobase sequences of SEQ ID Nos: 439, 1807, 1808, 1809, 1810, 1811, and 1812 are complementary to nucleobases 82,500-82,525 of SEQ ID NO: 2.

In certain embodiments, modified oligonucleotides complementary to nucleobases 82,500-82,525 of SEQ ID NO: 2 achieve at least 49% reduction of LRRK2 RNA in vitro in at least one single dose assay.

11. Nucleobases 91,038-91,067 of SEQ ID NO: 2

In certain embodiments, nucleobases 91,038-91,067 of SEQ ID NO: 2 comprise a hotspot region. In certain embodiments, siRNAs are complementary to nucleobases 91,038-91,067 of SEQ ID NO: 2. In certain embodiments, modified oligonucleotides are complementary to nucleobases 91,038-91,067 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 692, 1826, 1827, 1828, 1829, 1830, 1831, 1832, 1833, 1834, and 1835 are complementary to nucleobases 91,038-91,067 of SEQ ID NO: 2.

The modified oligonucleotides of Compound Nos: 780642, 803664, 803665, 803666, 803667, 803668, 803669, 803670, 803671, 803672, and 803673 are complementary to nucleobases 91,038-91,067 of SEQ ID NO: 2.

In certain embodiments, modified oligonucleotides complementary to nucleobases 91,038-91,067 of SEQ ID NO: 2 achieve at least 42% reduction of LRRK2 RNA in vitro in at least one single dose assay.

12. Nucleobases 92,148-92,173 of SEQ ID NO: 2

In certain embodiments, nucleobases 92,148-92,173 of SEQ ID NO: 2 comprise a hotspot region. In certain embodiments, siRNAs are complementary to nucleobases 92,148-92,173 of SEQ ID NO: 2. In certain embodiments, modified oligonucleotides are complementary to nucleobases 92,148-92,173 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 1213, 2613, 2690, 3143, 3219, and 3295 are complementary to nucleobases 92,148-92,173 of SEQ ID NO: 2.

In certain embodiments, modified oligonucleotides complementary to nucleobases 92,148-92,173 of SEQ ID NO: 2 achieve at least 59% reduction of LRRK2 RNA in vitro in at least one single dose assay.

13. Nucleobases 98,186-98,220 of SEQ ID NO: 2

In certain embodiments, nucleobases 98,186-98,220 of SEQ ID NO: 2 comprise a hotspot region. In certain embodiments, siRNAs are complementary to nucleobases 98,186-98,220 of SEQ ID NO: 2. In certain embodiments, modified oligonucleotides are complementary to nucleobases 98,186-98,220 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 1231, 1232, 2462, 2538, 2614, 2691, 2767, 3069, 3144, 3220, 3296 are complementary to nucleobases 98,186-98,220 of SEQ ID NO: 2.

In certain embodiments, modified oligonucleotides complementary to nucleobases 98,186-98,220 of SEQ ID NO: 2 achieve at least 55% reduction of LRRK2 RNA in vitro in at least one single dose assay.

14. Nucleobases 98,218-98,242 of SEQ ID NO: 2

In certain embodiments, nucleobases 98,218-98,242 of SEQ ID NO: 2 comprise a hotspot region. In certain embodiments, siRNAs are complementary to nucleobases 98,218-98,242 of SEQ ID NO: 2. In certain embodiments, modified oligonucleotides are complementary to nucleobases 98,218-98,242 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooosssssssssssooss.

The nucleobase sequences of SEQ ID Nos: 150, 1233, 2008, 3372, 3449, and 3524 are complementary to nucleobases 98,218-98,242 of SEQ ID NO: 2.

In certain embodiments, modified oligonucleotides complementary to nucleobases 98,218-98,242 of SEQ ID NO: 2 achieve at least 38% reduction of LRRK2 RNA in vitro in at least one single dose assay.

15. Nucleobases 99,199-99,223 of SEQ ID NO: 2

In certain embodiments, nucleobases 99,199-99,223 of SEQ ID NO: 2 comprise a hotspot region. In certain embodiments, siRNAs are complementary to nucleobases 99,199-99,223 of SEQ ID NO: 2. In certain embodiments, modified oligonucleotides are complementary to nucleobases 99,199-99,223 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssooss.

The nucleobase sequences of SEQ ID Nos: 1243, 2311, 2387, 2920, 2995, and 3755 are complementary to nucleobases 99,199-99,223 of SEQ ID NO: 2.

In certain embodiments, modified oligonucleotides complementary to nucleobases 99,199-99,223 of SEQ ID NO: 2 achieve at least 52% reduction of LRRK2 RNA in vitro in at least one single dose assay.

16. Nucleobases 119,903-119,936 of SEQ ID NO: 2

In certain embodiments, nucleobases 119,903-119,936 of SEQ ID NO: 2 comprise a hotspot region. In certain embodiments, siRNAs are complementary to nucleobases 119,903-119,936 of SEQ ID NO: 2. In certain embodiments, modified oligonucleotides are complementary to nucleobases 119,903-119,936 of SEQ ID NO: 2. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssooss.

The nucleobase sequences of SEQ ID Nos: 750, 1927, 1928, 1929, 1930, 1931, 1932, 1933, 1934, 1935, 2822, 2898, 3351, and 3733 are complementary to nucleobases 119,903-119,936 of SEQ ID NO: 2.

In certain embodiments, modified oligonucleotides complementary to nucleobases 119,903-119,936 of SEQ ID NO: 2 achieve at least 51% reduction of LRRK2 RNA in vitro in at least one single dose assay.

17. Nucleobases 4,062-4,086 of SEQ ID NO: 1

In certain embodiments, nucleobases 4,062-4,086 of SEQ ID NO: 1 comprise a hotspot region. In certain embodiments, siRNAs are complementary to nucleobases 4,062-4,086 of SEQ ID NO: 1. In certain embodiments, modified oligonucleotides are complementary to nucleobases 4,062-4,086 of SEQ ID NO: 1. In certain embodiments, modified oligonucleotides are 20 nucleobases in length. In certain embodiments, modified oligonucleotides are gapmers. In certain embodiments, the gapmers are 5-10-5 MOE gapmers. In certain embodiments, the internucleoside linkages of the modified oligonucleotides are phosphodiester ("o") and phosphorothioate ("s") internucleoside linkages. In certain embodiments, the phosphodiester ("o") and phosphorothioate ("s") internucleoside linkages are arranged in order from 5' to 3': sooossssssssssooss.

The nucleobase sequences of SEQ ID Nos: 39, 231, 232, 233, 1161, and 1162 are complementary to nucleobases 4,062-4,086 of SEQ ID NO: 1.

In certain embodiments, modified oligonucleotides complementary to nucleobases 4,062-4,086 of SEQ ID NO: 1 achieve at least 56% reduction of LRRK2 RNA in vitro in at least one single dose assay.

Nonlimiting Disclosure and Incorporation by Reference

Each of the literature and patent publications listed herein is incorporated by reference in its entirety.

While certain compounds, compositions and methods described herein have been described with specificity in accordance with certain embodiments, the following examples serve only to illustrate the compounds described herein and are not intended to limit the same. Each of the references, GenBank accession numbers, and the like recited in the present application is incorporated herein by reference in its entirety.

Although the sequence listing accompanying this filing identifies each sequence as either "RNA" or "DNA" as required, in reality, those sequences may be modified with any combination of chemical modifications. One of skill in the art will readily appreciate that such designation as "RNA" or "DNA" to describe modified oligonucleotides is, in certain instances, arbitrary. For example, an oligonucleotide comprising a nucleoside comprising a 2'-OH sugar moiety and a thymine base could be described as a DNA having a modified sugar (2'-OH in place of one 2'-H of DNA) or as an RNA having a modified base (thymine (methylated uracil) in place of a uracil of RNA). Accordingly, nucleic acid sequences provided herein, including, but not limited to those in the sequence listing, are intended to encompass nucleic acids containing any combination of natural or modified RNA and/or DNA, including, but not limited to such nucleic acids having modified nucleobases. By way of further example and without limitation, an oligomeric compound having the nucleobase sequence "ATCGATCG" encompasses any oligomeric compounds having such nucleobase sequence, whether modified or unmodified, including, but not limited to, such compounds comprising RNA bases, such as those having sequence "AUCGAUCG" and those having some DNA bases and some RNA bases such as "AUCGATCG" and oligomeric compounds having other modified nucleobases, such as "AT$^m$CGAUCG," wherein $^m$C indicates a cytosine base comprising a methyl group at the 5-position.

Certain compounds described herein (e.g., modified oligonucleotides) have one or more asymmetric center and thus give rise to enantiomers, diastereomers, and other stereoisomeric configurations that may be defined, in terms of absolute stereochemistry, as (R) or (S), as α or β such as for sugar anomers, or as (D) or (L), such as for amino acids, etc. Compounds provided herein that are drawn or described as having certain stereoisomeric configurations include only the indicated compounds. Compounds provided herein that are drawn or described with undefined stereochemistry include all such possible isomers, including their stereorandom and optically pure forms, unless specified otherwise. Likewise, tautomeric forms of the compounds herein are also included unless otherwise indicated. Unless otherwise indicated, compounds described herein are intended to include corresponding salt forms.

The compounds described herein include variations in which one or more atoms are replaced with a non-radioactive isotope or radioactive isotope of the indicated element. For example, compounds herein that comprise hydrogen atoms encompass all possible deuterium substitutions for each of the $^1$H hydrogen atoms. Isotopic substitutions encompassed by the compounds herein include but are not limited to: $^2$H or $^3$H in place of $^1$H, $^{13}$C or $^{14}$C in place of $^{12}$C, $^{15}$N in place of $^{14}$N, $^{17}$O or $^{18}$O in place of $^{16}$O, and $^{33}$S, $^{34}$S, $^{35}$S, or $^{36}$S in place of $^{32}$S. In certain embodiments, non-radioactive isotopic substitutions may impart new properties on the oligomeric compound that are beneficial for use as a therapeutic or research tool. In certain embodiments, radioactive isotopic substitutions may make the compound suitable for research or diagnostic purposes such as imaging.

EXAMPLES

The following examples illustrate certain embodiments of the present disclosure and are not limiting. Moreover, where specific embodiments are provided, the inventors have contemplated generic application of those specific embodiments. For example, disclosure of an oligonucleotide having a particular motif provides reasonable support for additional oligonucleotides having the same or similar motif. And, for example, where a particular high-affinity modification appears at a particular position, other high-affinity modifications at the same position are considered suitable, unless otherwise indicated.

Example 1: Effect of 5-10-5 Moe Gapmers with Phosphorothioate Internucleoside Linkages on Human Lrrk2 RNA Expression In Vitro, Single Dose Modified oligonucleotides complementary to a human LRRK2 nucleic acid were designed and tested for their effect on LRRK2 RNA in vitro.

Cultured SH-SY5Y cells at a density of 20,000 cells per well were transfected using electroporation with 5,000 nM concentration of modified oligonucleotide or no modified oligonucleotide for untreated controls. After approximately 24 hours, RNA was isolated from the cells and LRRK2 RNA levels were measured by quantitative real-time PCR. Human primer probe set RTS3133_MGB (forward sequence TTCCACACTTGCGGTCTTTAGA, designated herein as SEQ ID NO: 11; reverse sequence GCGGGACCTGGTAGGTACTG, designated herein as SEQ ID NO: 12; probe sequence ATGAGCAGCAATGAT, designated herein as SEQ ID: 13) was used to measure RNA levels. LRRK2 RNA levels were adjusted according to total RNA content, as measured by RIBOGREEN®. Results are presented in the table below as percent LRRK2 RNA levels relative to untreated control cells. The modified oligonucleotides with percent control values marked with an asterisk (*) target the amplicon region of the primer probe set. Additional assays may be used to measure the potency and efficacy of oligonucleotides targeting the amplicon region.

The modified oligonucleotides on Table 1 are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides. The sugar motif for the gapmers is (from 5' to 3'): eeeeedddddddddddeeeee; wherein 'd' represents a 2'-deoxyribose sugar and 'e' represents a 2'-MOE modified sugar. Each internucleoside linkage is a phosphorothioate internucleoside linkage and each cytosine residue is a 5-methyl cytosine. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Table 1 below is complementary to human LRRK2 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to the sequence of human LRRK2 RNA reduced the amount of human LRRK2 RNA.

TABLE 1

Percent control of human LRRK2 RNA with 5-10-5 MOE gapmers with phosphorothioate internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence | LRRK2 % control | SEQ ID NO |
|---|---|---|---|---|---|---|---|
| 422420 | 368 | 387 | 10392 | 10411 | ATTAATTTGCACAGAAGTGA | 75 | 30 |
| 422421 | 375 | 394 | 10399 | 10418 | GACTTCTATTAATTTGCACA | 65 | 31 |
| 422425 | 441 | 460 | 10465 | 10484 | ACCAAGGACTTCCCAATCAT | 111 | 32 |
| 422428 | 606 | 625 | 16126 | 16145 | GTGCATGGCATCAAAAATTA | 35 | 33 |
| 422433 | 1791 | 1810 | 52705 | 52724 | TCCACATTTCTGAATCCCAG | 24 | 34 |
| 422435 | 1904 | 1923 | N/A | N/A | TCTTGGTCATCTGGATACAT | 76 | 35 |
| 422436 | 1913 | 1932 | N/A | N/A | CACTGAATTTCTTGGTCATC | 84 | 36 |
| 422437 | 1919 | 1938 | N/A | N/A | CCCAGACACTGAATTTCTTG | 53 | 37 |
| 422450 | 3886 | 3905 | N/A | N/A | GAGGAATCTCTTTCAGTTTA | 58 | 38 |
| 422451 | 4064 | 4083 | 84059 | 84078 | AACCTTATGATGTCTTTGGC | 44 | 39 |
| 422456 | 4472 | 4491 | 88573 | 88592 | GAAACATCCAAATGTGTGCC | 64 | 40 |
| 422457 | 4484 | 4503 | 88585 | 88604 | TGCTTCTCATCAGAAACATC | 66 | 41 |
| 422458 | 4580 | 4599 | 88681 | 88700 | TCCTCGGTGGCATTCACAAA | 96 | 42 |
| 422461 | 4908 | 4927 | 93369 | 93388 | CCACTTGGGTTCCACAAAGT | 39 | 43 |
| 422462 | 4915 | 4934 | 93376 | 93395 | TACAAAGCCACTTGGGTTCC | 57 | 44 |
| 422466 | 5480 | 5499 | 100469 | 100488 | GGAAACCATTCTTCCATGAG | 85 | 45 |
| 422469 | 5702 | 5721 | 101340 | 101359 | TTTCTAGGCAGGTCAGCCAA | 74 | 46 |
| 422470 | 5978 | 5997 | 113175 | 113194 | AGCAGGCGATCCAAGGAACC | 90 | 47 |
| 422472 | 6139 | 6158 | 118472 | 118491 | CAATGATGGCAGCATTGGGA | 72 | 48 |
| 422475 | 6260 | 6279 | 124891 | 124910 | TGTTGGTTATAAATGACATT | 81 | 49 |
| 422477 | 6461 | 6480 | 126577 | 126596 | TGAGGATTTTCTTTCAAACA | 96 | 50 |
| 422479 | 6500 | 6519 | 129645 | 129664 | TTCAAAATGTCAAAGACCTG | 98 | 51 |
| 422480 | 6841 | 6860 | 132551 | 132570 | AAGTGACAGAATCAGTCATC | 83 | 52 |
| 422483 | 7108 | 7127 | 137512 | 137531 | TGAGTTTCTGAATGGTGAAA | 92 | 53 |
| 438386 | 117 | 136 | 3236 | 3255 | GCTGCCACTAGCCATGGTGG | 99 | 54 |
| 438387 | 185 | 204 | 3304 | 3323 | TCCTGGACATTGTTCAGCCT | 48 | 55 |
| 438388 | 381 | 400 | 10405 | 10424 | TGGACAGACTTCTATTAATT | 73 | 56 |
| 438401 | 3944 | 3963 | 83939 | 83958 | AGTTCCAAGTTGTAACTGAC | 71 | 57 |
| 438405 | 4408 | 4427 | 87312 | 87331 | AGAGCCAAGGCTTCATGGCA | 98 | 58 |
| 438408 | 4619 | 4638 | 88720 | 88739 | TTTATGATGGTTTTCCGAAG | 107 | 59 |
| 438410 | 4649 | 4668 | N/A | N/A | TGATCTCGGATCTTGAAATT | 88 | 60 |

TABLE 1-continued

Percent control of human LRRK2 RNA with 5-10-5 MOE gapmers with phosphorothioate internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence | LRRK2 % control | SEQ ID NO |
|---|---|---|---|---|---|---|---|
| 438429 | 8882 | 8901 | 147051 | 147070 | ATGAATACTGGTCAGGGCCA | 77 | 61 |
| 438432 | N/A | N/A | 4483 | 4502 | AAACTGATTTCAGTTCCCCA | 50 | 62 |
| 438433 | N/A | N/A | 52819 | 52838 | ACCTTGGTCATCTGGATACA | 93 | 63 |
| 438434 | N/A | N/A | 92072 | 92091 | TGATCTCGGATCTATGAAAT | 94 | 64 |
| 438436 | N/A | N/A | 114858 | 114877 | CCCCTGGTGTTCAAAAGCAG | 69 | 65 |
| 438437 | N/A | N/A | 129638 | 129657 | TGTCAAAGACCTGAGAAAGT | 116 | 66 |
| 438538 | 171 | 190 | 3290 | 3309 | CAGCCTGACTATCAACTTCT | 35 | 67 |
| 438539 | 436 | 455 | 10460 | 10479 | GGACTTCCCAATCATTTCCA | 90 | 68 |
| 438540 | 1074 | 1093 | N/A | N/A | GAAAATAGTCTCAGTGAGGA | 70 | 69 |
| 438541 | 1078 | 1097 | N/A | N/A | TTAAGAAAATAGTCTCAGTG | 98 | 70 |
| 438542 | 2275 | 2294 | 56283 | 56302 | CCATGATGCTGTTATTCTGA | 54 | 71 |
| 438543 | 2282 | 2301 | 56290 | 56309 | CATTCAACCATGATGCTGTT | 50 | 72 |
| 438544 | 2361 | 2380 | 61982 | 62001 | GCTCTCTTTCTCACATACCT | 22 | 73 |
| 438545 | 2366 | 2385 | 61987 | 62006 | GGACTGCTCTCTTTCTCACA | 26 | 74 |
| 438546 | 2525 | 2544 | 62146 | 62165 | AATCCTCCAAGGCAAATGCT | 55 | 75 |
| 438547 | 2564 | 2583 | 62185 | 62204 | AAAGGACCAAGCCAAGAAGG | 58 | 76 |
| 438548 | 2571 | 2590 | 62192 | 62211 | TGGAAATAAAGGACCAAGCC | 27 | 77 |
| 438549 | 2759 | 2778 | 65597 | 65616 | ACACTGTCCATAGAAGAGTC | 56 | 78 |
| 438550 | 2764 | 2783 | 65602 | 65621 | CAAACACACTGTCCATAGAA | 44 | 79 |
| 438551 | 3503 | 3522 | 77252 | 77271 | AAAATCTTCAGTTCCTTCAG | 82 | 80 |
| 438552 | 3857 | 3876 | 82202 | 82221 | AGATGCAGTTTCTCTACTCT | 67 | 81 |
| 438553 | 4300 | 4319 | N/A | N/A | CCTCACGACCTGCAAAATCC | 65 | 82 |
| 438554 | 4305 | 4324 | N/A | N/A | GAATTCCTCACGACCTGCAA | 77 | 83 |
| 438555 | 4480 | 4499 | 88581 | 88600 | TCTCATCAGAAACATCCAAA | 77 | 84 |
| 438556 | 4575 | 4594 | 88676 | 88695 | GGTGGCATTCACAAAGTGGT | 52 | 85 |
| 438557 | 4641 | 4660 | N/A | N/A | GATCTTGAAATTAAGGCTCT | 69 | 86 |
| 438558 | 5225 | 5244 | 99231 | 99250 | AATCTTGACCAAAATCCCAT | 79 | 87 |
| 438559 | 5530 | 5549 | 100519 | 100538 | TCTTCAACAGAGTTTCTCCT | 81 | 88 |
| 438560 | 5537 | 5556 | 100526 | 100545 | GCCCATTTCTTCAACAGAGT | 30 | 89 |
| 438561 | 5568 | 5587 | 100557 | 100576 | ATGTTCTTCACCATCATTAA | 98 | 90 |
| 438562 | 5735 | 5754 | 101373 | 101392 | TCAAATTCCAACTCATCATT | 111 | 91 |
| 438563 | 5825 | 5844 | 106516 | 106535 | AAAATCTTCACAGCCACTTC | 109 | 92 |
| 438564 | 5829 | 5848 | 106520 | 106539 | ATTAAAAATCTTCACAGCCA | 136 | 93 |
| 438565 | 6000 | 6019 | 113197 | 113216 | GAGGCTGGCTTTGTCCTGCT | 52 | 94 |
| 438566 | 6074 | 6093 | 118407 | 118426 | ATAATCATGGCTGAGTGGAG | 83 | 95 |
| 438567 | 6135 | 6154 | 118468 | 118487 | GATGGCAGCATTGGGATACA | 90 | 96 |
| 438568 | 6401 | 6420 | 126517 | 126536 | CCATATTCTTTAACTGGATC | 74 | 97 |
| 438569 | 6427 | 6446 | 126543 | 126562 | TCTCAACCATAGGCCATGGG | 47 | 98 |
| 438570 | 6465 | 6484 | 126581 | 126600 | TTCTTGAGGATTTTCTTTCA | 106 | 99 |
| 438571 | 6494 | 6513 | N/A | N/A | ATGTCAAAGACCTGGGCAGA | 107 | 100 |
| 438572 | 6572 | 6591 | 129717 | 129736 | GCAACCATGCATTCAACAAT | 76 | 101 |
| 438573 | 6696 | 6715 | 132406 | 132425 | TCTACTATCAGCAACTTCCT | 89 | 102 |
| 438574 | 6845 | 6864 | 132555 | 132574 | AAACAAGTGACAGAATCAGT | 110 | 103 |
| 438575 | 7632 | 7651 | 145801 | 145820 | GTGTTTTTCTAAATTTTGCA | 65 | 104 |
| 438576 | 7640 | 7659 | 145809 | 145828 | ACTTCAATGTGTTTTTCTAA | 105 | 105 |
| 438577 | N/A | N/A | 3658 | 3677 | AAATAACTTGGAGGCTGGAA | 114 | 106 |
| 438578 | N/A | N/A | 4487 | 4506 | GACAAAACTGATTTCAGTTC | 82 | 107 |
| 438579 | N/A | N/A | 77354 | 77373 | CACTTACCAAGAAAATTCAT | 118 | 108 |
| 438580 | N/A | N/A | 116733 | 116752 | ATTATAGAATTTAATCTTAA | 96 | 109 |
| 438581 | N/A | N/A | 142937 | 142956 | ACCTCCCTAGAACCATAAAG | 104 | 110 |
| 438582 | 60 | 79 | 3179 | 3198 | TCCGCTGCTCAGGGAACCGG | 65 | 111 |
| 438583 | 449 | 468 | 10473 | 10492 | TGGTGAACACCAAGGACTTC | 55 | 112 |
| 438584 | 457 | 476 | N/A | N/A | GAATCAATTGGTGAACACCA | 63 | 113 |
| 438585 | 529 | 548 | 13795 | 13814 | GGAGGAGATCTAAGGTCTTC | 90 | 114 |
| 438586 | 550 | 569 | N/A | N/A | AGGTGATTTACCTGAAGTT | 64 | 115 |
| 438587 | 624 | 643 | 16144 | 16163 | ATCATTGGCTGGAAATGAGT | 51 | 116 |
| 438588 | 883 | 902 | 21714 | 21733 | GGAATGCTTTCATAGCTTCC | 56 | 117 |
| 438589 | 1166 | 1185 | 29427 | 29446 | TTGTAACAGCTTCCAGCCA | 53 | 118 |
| 438590 | 1300 | 1319 | N/A | N/A | CCCTATGAGCTGGGAAATGG | 79 | 119 |
| 438591 | 1534 | 1553 | N/A | N/A | CCAGGGAAGTGTTGCTTCCT | 77 | 120 |
| 438592 | 1610 | 1629 | 37659 | 37678 | TCCAGCTGCACTGGTAATGA | 90 | 121 |
| 438593 | 1774 | 1793 | N/A | N/A | CAGGATTTCCAATGAACCTG | 72 | 122 |
| 438594 | 1885 | 1904 | 52799 | 52818 | TCTGCAGTGTGTGAAGCACT | 76 | 123 |
| 438595 | 2108 | 2127 | 56042 | 56061 | TGATGCACCAGCAGCTTAGA | 48 | 124 |
| 438596 | 2318 | 2337 | 56326 | 56345 | TTTGCTTGATTGGCATCTGC | 55 | 125 |
| 438597 | 2380 | 2399 | 62001 | 62020 | GTTCCACCAATTTGGGACTG | 34 | 126 |
| 438598 | 2412 | 2431 | 62033 | 62052 | ATCTTGTTCACGAGATCCAC | 70 | 127 |
| 438599 | 2515 | 2534 | 62136 | 62155 | GGCAAATGCTATTGTTGGCC | 63 | 128 |
| 438600 | 3171 | 3190 | 73707 | 73726 | GAGTGCATTCTGGTGAAGCT | 70 | 129 |
| 438601 | 3211 | 3230 | N/A | N/A | AACTCTTCAGAGTTTCACAT | 94 | 130 |
| 438602 | 3475 | 3494 | 77224 | 77243 | GGGAGCATATCCCTGATATT | 42 | 131 |

TABLE 1-continued

Percent control of human LRRK2 RNA with 5-10-5 MOE gapmers with phosphorothioate internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence | LRRK2 % control | SEQ ID NO |
|---|---|---|---|---|---|---|---|
| 438603 | 3565 | 3584 | 77314 | 77333 | CTTTAGGACAAGCCTCAAGA | 71 | 132 |
| 438604 | 3702 | 3721 | N/A | N/A | AGACCGCAAGTGTGGAAGAT | 17* | 133 |
| 438605 | 3707 | 3726 | N/A | N/A | TCTAAAGACCGCAAGTGTGG | 22* | 134 |
| 438606 | 3930 | 3949 | 83925 | 83944 | ACTGACATCCAGAGATGTCA | 126 | 135 |
| 438607 | 3952 | 3971 | 83947 | 83966 | AGGATCTTAGTTCCAAGTTG | 95 | 136 |
| 438608 | 3957 | 3976 | 83952 | 83971 | GGGAAAGGATCTTAGTTCCA | 70 | 137 |
| 438609 | 3969 | 3988 | 83964 | 83983 | CCCCATTTCATTGGGAAAGG | 77 | 138 |
| 438610 | 4190 | 4209 | 86685 | 86704 | CCAAGATCTGATTTCTTGGT | 104 | 139 |
| 438611 | 4353 | 4372 | 87257 | 87276 | AGCAAGGTACAATGCTCGCT | 69 | 140 |
| 438612 | 4395 | 4414 | 87299 | 87318 | CATGGCATCAACTTCAGCCT | 83 | 141 |
| 438613 | 4413 | 4432 | 87317 | 87336 | ATTGAAGAGCCAAGGCTTCA | 94 | 142 |
| 438614 | 4422 | 4441 | N/A | N/A | AGCCTTTATATTGAAGAGCC | 103 | 143 |
| 438615 | 4428 | 4447 | N/A | N/A | AGCGCGAGCCTTTATATTGA | 91 | 144 |
| 438616 | 4433 | 4452 | N/A | N/A | GAAGAAGCGCGAGCCTTTAT | 66 | 145 |
| 438617 | 4544 | 4563 | 88645 | 88664 | GCAGGGAACCCTCGCTTATT | 97 | 146 |
| 438618 | 4682 | 4701 | 92105 | 92124 | TAGCAGTCTGGAATCAGCTG | 89 | 147 |
| 438619 | 4816 | 4835 | 92239 | 92258 | CGTGAGGAAGCTCATTTTCA | 70 | 148 |
| 438620 | 4963 | 4982 | 98111 | 98130 | GTTTTGGACAACCTTCCACT | 96 | 149 |
| 438621 | 5074 | 5093 | 98222 | 98241 | TCTGGAATTTTTCTAGGAGC | 62 | 150 |
| 438622 | 5116 | 5135 | 98264 | 98283 | TGCTTGGAACCAGCAAATAT | 78 | 151 |
| 438623 | 5451 | 5470 | 100440 | 100459 | GTGGTCCACAACTTGGCCCA | 71 | 152 |
| 438624 | 5745 | 5764 | 101383 | 101402 | TGGAGCTTGTTCAAATTCCA | 104 | 153 |
| 438625 | 5887 | 5906 | 113084 | 113103 | GGTGGAGGTGGCAAAGCACC | 78 | 154 |
| 438626 | 5968 | 5987 | 113165 | 113184 | CCAAGGAACCCTTGGAGGCT | 97 | 155 |
| 438627 | 5986 | 6005 | 113183 | 113202 | CCTGCTGAAGCAGGCGATCC | 75 | 156 |
| 438628 | 5991 | 6010 | 113188 | 113207 | TTTGTCCTGCTGAAGCAGGC | 89 | 157 |
| 438629 | 6058 | 6077 | N/A | N/A | GGAGGTATCTCAAACCATCA | 111 | 158 |
| 438630 | 6149 | 6168 | 118482 | 118501 | GCAATCTTTGCAATGATGGC | 72 | 159 |
| 438631 | 6157 | 6176 | 118490 | 118509 | CGTAGTCAGCAATCTTTGCA | 78 | 160 |
| 438632 | 6581 | 6600 | 129726 | 129745 | TGATGTGTAGCAACCATGCA | 62 | 161 |
| 438633 | 6586 | 6605 | 129731 | 129750 | TGTTGTGATGTGTAGCAACC | 77 | 162 |
| 438634 | 6613 | 6632 | 129758 | 129777 | AGCCCAGCCAAATGCTTGCA | 97 | 163 |
| 438635 | 6624 | 6643 | 129769 | 129788 | GGTGTGCCCACAGCCCAGCC | 70 | 164 |
| 438636 | 6677 | 6696 | 129822 | 129841 | TCAGAAGTGTATCCTTCAGT | 95 | 165 |
| 438637 | 7373 | 7392 | 143021 | 143040 | GCAGTGTTCTTCTGAAGGCA | 100 | 166 |
| 438638 | 7482 | 7501 | 143130 | 143149 | TGTCATCATGACTCTGACCG | 74 | 167 |
| 438639 | 8333 | 8352 | 146502 | 146521 | AGGACTTTGACAGTATGTCA | 66 | 168 |
| 438640 | 8696 | 8715 | 146865 | 146884 | TCCTTCAGCAACTGAAAAGT | 85 | 169 |
| 438641 | 8748 | 8767 | 146917 | 146936 | TGGAAGCCTAGGGTGGCAGA | 62 | 170 |
| 438642 | 8914 | 8933 | 147083 | 147102 | AGTTGTCCTATCACAGGGAA | 90 | 171 |
| 438643 | N/A | N/A | 78939 | 78958 | ATCAGATTCCCCTGAGGTAC | 93 | 172 |
| 438644 | N/A | N/A | 78947 | 78966 | CAGTCTGAATCAGATTCCCC | 85 | 173 |
| 438645 | N/A | N/A | 143365 | 143384 | GTTCAGCTGCAGTAATCTGC | 67 | 174 |
| 438646 | N/A | N/A | 143372 | 143391 | ACTGAGTGTTCAGCTGCAGT | 80 | 175 |
| 438647 | N/A | N/A | 143377 | 143396 | CCCAAACTGAGTGTTCAGCT | 99 | 176 |
| 438648 | N/A | N/A | 10479 | 10498 | ACTTACTGGTGAACACCAAG | 121 | 177 |
| 438649 | N/A | N/A | 31012 | 31031 | ATGAGCTGGGAAACTTTCAA | 84 | 178 |
| 438650 | N/A | N/A | 41888 | 41907 | TCTGGCATGCCTAAATGCAC | 10 | 179 |
| 438651 | N/A | N/A | 52827 | 52846 | TTGTACTGACCTTGGTCATC | 126 | 180 |
| 438652 | N/A | N/A | 76342 | 76361 | TCTTCAGAGTCTGAAAAGAC | 83 | 181 |
| 438653 | N/A | N/A | 88530 | 88549 | AAGCGCGAGCCTGGAGGGAA | 89 | 182 |
| 438654 | N/A | N/A | 118392 | 118411 | TGGAGGTATCTGCCAGAAAA | 91 | 183 |
| 438655 | N/A | N/A | 118553 | 118572 | ATCACCTACCTGGTGTGCCC | 122 | 184 |

Example 2: Effect of 5-10-5 MOE Gapmers with Mixed Internucleoside Linkages on Human LRRK2 RNA Expression In Vitro, Single Dose Modified oligonucleotides complementary to a human LRRK2 nucleic acid were designed and tested for their effect on LRRK2 RNA in vitro. The modified oligonucleotides were tested in a series of experiments that had similar culture conditions.

Cultured SH-SY5Y cells at a density of 20,000 cells per well were transfected using electroporation with 5,000 nM concentration of modified oligonucleotide or no modified oligonucleotide for untreated controls. After approximately 24 hours, RNA was isolated from the cells and LRRK2 RNA levels were measured by quantitative real-time PCR. Human primer probe sets RTS3132 (forward sequence CATCACTCAGGCTGTTAAGACAAGA, designated herein as SEQ ID NO: 14; reverse sequence CAGCTGCCAGCAAAGATATCAA, designated herein as SEQ TD NO: 15; probe sequence CTTTGCCACCTCCACCACCCCA, designated herein as SEQ ID: 16), RTS3133_MGB (forward sequence TTCCACACTTGCGGTCTTTAGA, designated herein as SEQ ID NO: 11; reverse sequence GCGGGACCTGGTAGGTACTG, designated herein as SEQ ID NO: 12; probe sequence ATGAGCAGCAATGAT, designated herein as SEQ ID: 13), and RTS3146_MGB (forward sequence GAGCTTCCTCACGCAGTTCAC, designated herein as SEQ ID NO: 17; reverse sequence TGCTGGGTCTTGAAAATGAAGA, designated herein as SEQ TD NO: 18; probe sequence TTCTAAATGAATCAGGAGTCC, designated herein as SEQ ID: 19) were used to measure RNA levels. LRRK2 RNA levels were adjusted according to total RNA content, as measured by RIBOGREEN®. Results are presented in the table below as percent LRRK2 RNA levels relative to untreated control cells. The modified oligonucleotides with percent control values marked with an asterisk (*) target the amplicon region of the primer probe set.

The modified oligonucleotides in Table 2 are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides. The sugar motif for the gapmers is (from 5' to 3'): eeeeeddddddddddeeeee; wherein 'd' represents a 2'-deoxyribose sugar and 'e' represents a 2'-MOE modified sugar. All cytosine residues throughout each gapmer are 5-methyl cytosines. The internucleoside linkages for each gapmer are mixed phosphodiester and phosphorothioate linkages. The internucleoside linkage motif for the gapmers is (from 5' to 3'): sooosssssssssssooss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Table 2 below is complementary to human LRRK2 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to the sequence of human LRRK2 RNA reduced the amount of human LRRK2 RNA.

TABLE 2

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control RTS3132 | LRRK2 % control RTS3133_MGB | LRRK2 % control RTS3146_MGB | SEQ ID NO |
|---|---|---|---|---|---|---|---|---|---|
| 693423 | 4064 | 4083 | 84059 | 84078 | AACCTTATGATGTCTTTGGC | 15 | 31 | 18 | 39 |
| 693424 | 4908 | 4927 | 93369 | 93388 | CCACTTGGGTTCCACAAAGT | 24 | 31 | 24 | 43 |
| 693428 | 2361 | 2380 | 61982 | 62001 | GCTCTCTTTCTCACATACCT | 10 | 14 | 11 | 73 |
| 693429 | 2571 | 2590 | 62192 | 62211 | TGGAAATAAAGGACCAAGCC | 26 | 31 | 27 | 77 |
| 780202 | 2368 | 2387 | 61989 | 62008 | TGGGACTGCTCTCTTTCTCA | 19 | 26 | 20 | 185 |
| 780203 | 2371 | 2390 | 61992 | 62011 | ATTTGGGACTGCTCTCTTTC | 28 | 36 | 32 | 186 |
| 780204 | 2406 | 2425 | 62027 | 62046 | TTCACGAGATCCACTATTCA | 48 | 51 | 51 | 187 |
| 780205 | 2451 | 2470 | 62072 | 62091 | GTCACCTTTCCCAATGCTTA | 21 | 35 | 29 | 188 |
| 780206 | 2499 | 2518 | 62120 | 62139 | GGCCACATCCAGGGCCAGCC | 56 | 62 | 45 | 189 |
| 780207 | 2543 | 2562 | 62164 | 62183 | TCAACTTTTCCTATACAAAA | 38 | 42 | 47 | 190 |
| 780208 | 2566 | 2585 | 62187 | 62206 | ATAAAGGACCAAGCCAAGAA | 53 | 56 | 64 | 191 |
| 780209 | 2569 | 2588 | 62190 | 62209 | GAAATAAAGGACCAAGCCAA | 48 | 53 | 54 | 192 |
| 780210 | 2573 | 2592 | 62194 | 62213 | TCTGGAAATAAAGGACCAAG | 21 | 24 | 27 | 193 |
| 780211 | 2576 | 2595 | 62197 | 62216 | TTATCTGGAAATAAAGGACC | 39 | 37 | 41 | 194 |
| 780212 | 2587 | 2606 | 62208 | 62227 | AATTAGAAGTCTTATCTGGA | 59 | 61 | 59 | 195 |
| 780213 | 2632 | 2651 | 65470 | 65489 | TCACCATTCTTGCTAGTGTA | 41 | 42 | 50 | 196 |
| 780214 | 2678 | 2697 | 65516 | 65535 | CCTGAGGCTGTTCCTTCTTC | 37 | 47 | 44 | 197 |
| 780215 | 2722 | 2741 | 65560 | 65579 | CATCAAATTTAGACAGCACA | 41 | 44 | 48 | 198 |
| 780216 | 2759 | 2778 | 65597 | 65616 | ACACTGTCCATAGAAGAGTC | 50 | 48 | 45 | 78 |
| 780217 | 2762 | 2781 | 65600 | 65619 | AACACTGTCCATAGAAGA | 41 | 47 | 43 | 199 |
| 780218 | 2764 | 2783 | 65602 | 65621 | CAAACACACTGTCCATAGAA | 31 | 39 | 37 | 79 |
| 780219 | 2766 | 2785 | 65604 | 65623 | AGCAAACACACTGTCCATAG | 21 | 27 | 24 | 200 |
| 780220 | 2769 | 2788 | 65607 | 65626 | TTGAGCAAACACACTGTCCA | 34 | 37 | 36 | 201 |
| 780221 | 2810 | 2829 | 71653 | 71672 | AGAAATGAGCCTTCACTTCC | 35 | 49 | 41 | 202 |
| 780222 | 2854 | 2873 | 71697 | 71716 | GGTAAAATTCTCCTACACTA | 37 | 39 | 38 | 203 |
| 780223 | 2898 | 2917 | 71741 | 71760 | ATGTCTTTGCAAATTTGGTG | 41 | 46 | 38 | 204 |
| 780224 | 2942 | 2961 | 72966 | 72985 | TTCAGTAAATCTTCATGATC | 55 | 57 | 64 | 205 |
| 780225 | 2986 | 3005 | N/A | N/A | ATGACCTGAGTGAATCATCT | 51 | 46 | 55 | 206 |
| 780226 | 3031 | 3050 | 73567 | 73586 | GAGAAGAAATGCTGTCTGAA | 54 | 61 | 62 | 207 |
| 780227 | 3075 | 3094 | 73611 | 73630 | TGCTGAAAGGTCTAGTGATG | 34 | 37 | 37 | 208 |
| 780228 | 3120 | 3139 | 73656 | 73675 | TATACAGCATTTCTGGCTTA | 61 | 79 | 59 | 209 |
| 780229 | 3164 | 3183 | 73700 | 73719 | TTCTGGTGAAGCTCCAGCTT | 27 | 32 | 29 | 210 |
| 780230 | 3208 | 3227 | N/A | N/A | TCTTCAGAGTTTCACATAGC | 62 | 70 | 61 | 211 |
| 780231 | 3256 | 3275 | 76390 | 76409 | AAGGAAATGATGTAAATTTA | 65 | 70 | 69 | 212 |
| 780232 | 3300 | 3319 | 76434 | 76453 | AGAGACATCAAGATTAGCAA | 24 | 33 | 35 | 213 |
| 780233 | 3344 | 3363 | 76478 | 76497 | TTCACTGTAGGATCTAAAAC | 46 | 45 | 45 | 214 |
| 780234 | 3389 | 3408 | 76523 | 76542 | GACAGCTGGTTATATGACAG | 30 | 31 | 29 | 215 |
| 780235 | 3433 | 3452 | 76567 | 76586 | GCTCCAGTTTCTCTACCACA | 41 | 40 | 50 | 216 |
| 780236 | 3494 | 3513 | 77243 | 77262 | AGTTCCTTCAGTCTCAAGGG | 16 | 31 | 22 | 217 |
| 780237 | 3538 | 3557 | 77287 | 77306 | CTGATAGGGATGAAATGTGG | 27 | 31 | 28 | 218 |
| 780238 | 3582 | 3601 | 77331 | 77350 | GGCACTGAAACTCTCCACTT | 25 | 37 | 27 | 219 |
| 780239 | 3626 | 3645 | 80906 | 80925 | ATAGAAGGAGGCAAGAAAGG | 47 | 60 | 67 | 220 |
| 780240 | 3670 | 3689 | 80950 | 80969 | CTGGAATACAGGAAAATTTG | 52 | 44 | 51 | 221 |
| 780241 | 3714 | 3733 | 82059 | 82078 | GCTCATATCTAAAGACCGCA | 10 | 3* | 13 | 222 |
| 780242 | 3758 | 3777 | 82103 | 82122 | GATTTCCAGTGTGCGGGACC | 27 | 20* | 33 | 223 |

TABLE 2-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control RTS3132 | LRRK2 % control RTS3133_MGB | LRRK2 % control RTS3146_MGB | SEQ ID NO |
|---|---|---|---|---|---|---|---|---|---|
| 780243 | 3802 | 3821 | 82147 | 82166 | TGCTGATCTGATTATGGCTA | 22 | 36 | 33 | 224 |
| 780244 | 3846 | 3865 | 82191 | 82210 | CTCTACTCTAGACCATAAAT | 25 | 32 | 28 | 225 |
| 780245 | 3891 | 3910 | N/A | N/A | CTCAGGAGGAATCTCTTTCA | 43 | 47 | 51 | 226 |
| 780246 | 3935 | 3954 | 83930 | 83949 | TTGTAACTGACATCCAGAGA | 63 | 75 | 74 | 227 |
| 780247 | 3979 | 3998 | 83974 | 83993 | TGCTTAATTTCCCCATTTCA | 23 | 41 | 37 | 228 |
| 780248 | 4023 | 4042 | 84018 | 84037 | ATCAAAGTTAAGATGCAGTT | 25 | 30 | 29 | 229 |
| 780249 | 4059 | 4078 | 84054 | 84073 | TATGATGTCTTTGGCTTAC | 33 | 41 | 36 | 230 |
| 780250 | 4062 | 4081 | 84057 | 84076 | CCTTATGATGTCTTTGGCTT | 28 | 34 | 31 | 231 |
| 780251 | 4066 | 4085 | N/A | N/A | GAAACCTTATGATGTCTTTG | 42 | 39 | 41 | 232 |
| 780252 | 4067 | 4086 | N/A | N/A | AGAAACCTTATGATGTCTTT | 34 | 45 | 50 | 233 |
| 780253 | 4069 | 4088 | N/A | N/A | GAAGAAACCTTATGATGTCT | 44 | 61 | 47 | 234 |
| 780254 | 4111 | 4130 | 86606 | 86625 | GTTTCATTCGGTTATAAGGC | 17 | 24 | 14 | 235 |
| 780255 | 4155 | 4174 | 86650 | 86669 | CAATAAGGTGGTTTTACCAC | 35 | 51 | 47 | 236 |
| 780256 | 4199 | 4218 | 86694 | 86713 | CTTTGCATTCCAAGATCTGA | 30 | 33 | 32 | 237 |
| 780257 | 4243 | 4262 | 86738 | 86757 | TTATTTGGATAGGCCAGTCT | 34 | 42 | 50 | 238 |
| 780258 | 4287 | 4306 | 86782 | 86801 | AAAATCCCACACATTTAGGA | 54 | 60 | 57 | 239 |
| 780259 | 4350 | 4369 | 87254 | 87273 | AAGGTACAATGCTCGCTGCG | 51 | 65 | 51 | 240 |
| 780260 | 4394 | 4413 | 87298 | 87317 | ATGGCATCAACTTCAGCCTG | 45 | 41 | 49 | 241 |
| 780261 | 4438 | 4457 | 88539 | 88558 | GGGAAGAAGAAGCGCGAGCC | 29 | 41 | 32 | 242 |
| 780262 | 4483 | 4502 | 88584 | 88603 | GCTTCTCATCAGAAACATCC | 30 | 41 | 35 | 243 |
| 780263 | 4527 | 4546 | 88628 | 88647 | ATTCAGGAGTTCCTTGGTGA | 43 | 85 | 47 | 244 |
| 780264 | 4571 | 4590 | 88672 | 88691 | GCATTCACAAAGTGGTAATC | 35 | 43 | 35 | 245 |
| 780265 | 4615 | 4634 | 88716 | 88735 | TGATGGTTTTCCGAAGTTTT | 43 | 46 | 49 | 246 |
| 780266 | 4659 | 4678 | 92082 | 92101 | AACAACAAGCTGATCTCGGA | 49 | 57 | 56 | 247 |
| 780267 | 4703 | 4722 | 92126 | 92145 | ATGATTTTTTCAAGTTCTAC | 31 | 47 | 45 | 248 |
| 780268 | 4747 | 4766 | 92170 | 92189 | CAATTACGGGAAATTCAATT | 68 | 60 | 57 | 249 |
| 780269 | 4791 | 4810 | 92214 | 92233 | CTGCAGCTGATTTTCTCTCA | 23 | 32 | 27 | 250 |
| 780270 | 4835 | 4854 | 92258 | 92277 | TCATTTAGAAAGTGAACTGC | 40 | 51 | 54* | 251 |
| 780271 | 4883 | 4902 | 93344 | 93363 | TCACTTAACTGCAGTGCTGG | 27 | 38 | 10* | 252 |
| 780272 | 4903 | 4922 | 93364 | 93383 | TGGGTTCCACAAAGTACAAG | 41 | 47 | 42 | 253 |
| 780273 | 4906 | 4925 | 93367 | 93386 | ACTTGGGTTCCACAAAGTAC | 42 | 38 | 38 | 254 |
| 780274 | 4910 | 4929 | 93371 | 93390 | AGCCACTTGGGTTCCACAAA | 28 | 43 | 30 | 255 |
| 780275 | 4913 | 4932 | 93374 | 93393 | CAAAGCCACTTGGGTTCCAC | 31 | 43 | 38 | 256 |

Example 3: Effect of 5-10-5 MOE Gapmers with Mixed Internucleoside Linkages on Human LRRK2 RNA Expression In Vitro, Single Dose Modified oligonucleotides complementary to a human LRRK2 nucleic acid were designed and tested for their effect on LRRK2 RNA in vitro. The modified oligonucleotides were tested in a series of experiments that had similar culture conditions.

Cultured SH-SY5Y cells at a density of 20,000 cells per well were transfected using electroporation with 3,000 nM concentration of modified oligonucleotide or no modified oligonucleotide for untreated controls. After approximately 24 hours, RNA was isolated from the cells and LRRK2 RNA levels were measured by quantitative real-time PCR using human primer probe set RTS3132 as described in Example 2. LRRK2 RNA levels were adjusted according to total RNA content, as measured by RIBOGREEN® Results are presented in the table below as percent LRRK2 RNA levels relative to untreated control cells. The modified oligonucleotides with percent control values marked with an asterisk (*) target the amplicon region of the primer probe set. Additional assays may be used to measure the potency and efficacy of oligonucleotides targeting the amplicon region.

The modified oligonucleotides in Tables 3-9 are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides. The sugar motif for the gapmers is (from 5' to 3'): eeeeedddddddddeeeee; wherein 'd' represents a 2'-deoxyribose sugar and 'e' represents a 2'-MOE modified sugar. All cytosine residues throughout each gapmer are 5-methyl cytosines. The internucleoside linkages for each gapmer are mixed phosphodiester and phosphorothioate linkages. The internucleoside linkage motif for the gapmers is (from 5' to 3'): sooosssssssssssoss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Tables 3-9 below is complementary to human LRRK2 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to the sequence of human LRRK2 RNA reduced the amount of human LRRK2 RNA.

TABLE 3

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 690092 | 171 | 190 | 3290 | 3309 | CAGCCTGACTATCAACTTCT | 57 | 67 |
| 690093 | 2366 | 2385 | 61987 | 62006 | GGACTGCTCTCTTTCTCACA | 70 | 74 |
| 693420 | 606 | 625 | 16126 | 16145 | GTGCATGGCATCAAAAATTA | 41 | 33 |
| 693421 | 1791 | 1810 | 52705 | 52724 | TCCACATTTCTGAATCCCAG | 48 | 34 |
| 693428 | 2361 | 2380 | 61982 | 62001 | GCTCTCTTTCTCACATACCT | 51 | 73 |
| 693438 | 883 | 902 | 21714 | 21733 | GGAATGCTTTCATAGCTTCC | 43 | 117 |
| 725607 | 2362 | 2381 | 61983 | 62002 | TGCTCTCTTTCTCACATACC | 35 | 257 |
| 725608 | 2363 | 2382 | 61984 | 62003 | CTGCTCTCTTTCTCACATAC | 40 | 258 |
| 725609 | 2364 | 2383 | 61985 | 62004 | ACTGCTCTCTTTCTCACATA | 62 | 259 |
| 780133 | 1 | 20 | 3120 | 3139 | TCACCGCCCGCAGCCAGCGC | 95 | 260 |
| 780134 | 56 | 75 | 3175 | 3194 | CTGCTCAGGGAACCGGCAGG | 134 | 261 |
| 780135 | 100 | 119 | 3219 | 3238 | TGGCACCTGCTTCCAACCCG | 115 | 262 |
| 780136 | 157 | 176 | 3276 | 3295 | ACTTCTTCAGAGTTTCCTCG | 59 | 263 |
| 780137 | 166 | 185 | 3285 | 3304 | TGACTATCAACTTCTTCAGA | 86 | 264 |
| 780138 | 169 | 188 | 3288 | 3307 | GCCTGACTATCAACTTCTTC | 59 | 265 |
| 780139 | 173 | 192 | 3292 | 3311 | TTCAGCCTGACTATCAACTT | 70 | 266 |
| 780140 | 176 | 195 | 3295 | 3314 | TTGTTCAGCCTGACTATCAA | 87 | 267 |
| 780141 | 203 | 222 | 3322 | 3341 | GTTTCTATCTGTTTTCCTTC | 44 | 268 |
| 780142 | 271 | 290 | N/A | N/A | CTTGAAATAACTTGGAGGCG | 72 | 269 |
| 780143 | 315 | 334 | 3706 | 3725 | ATAGGAGTCCAAGACGATCA | 49 | 270 |
| 780144 | 362 | 381 | 10386 | 10405 | TTGCACAGAAGTGACCAACC | 64 | 271 |
| 780145 | 406 | 425 | 10430 | 10449 | GTCCCATTAAGCTTTGCATT | 48 | 272 |
| 780146 | 451 | 470 | N/A | N/A | ATTGGTGAACACCAAGGACT | 48 | 273 |
| 780147 | 495 | 514 | 13761 | 13780 | CAAGTTTACACTGGCATTAT | 57 | 274 |
| 780148 | 539 | 558 | 13805 | 13824 | CCTGAAGTTAGGAGGAGATC | 32 | 275 |
| 780149 | 585 | 604 | 16105 | 16124 | CATGAAAATATCACTTTCTT | 76 | 276 |
| 780150 | 601 | 620 | 16121 | 16140 | TGGCATCAAAAATTAACATG | 70 | 277 |
| 780151 | 604 | 623 | 16124 | 16143 | GCATGGCATCAAAAATTAAC | 96 | 278 |
| 780152 | 608 | 627 | 16128 | 16147 | GAGTGCATGGCATCAAAAAT | 44 | 279 |
| 780153 | 611 | 630 | 16131 | 16150 | AATGAGTGCATGGCATCAAA | 74 | 280 |
| 780154 | 629 | 648 | 16149 | 16168 | ACTTCATCATTGGCTGGAAA | 57 | 281 |
| 780155 | 673 | 692 | 16193 | 16212 | CTCTCTCAAACAGCACATGT | 74 | 282 |
| 780156 | 717 | 736 | 18616 | 18635 | ATAATCTTTGTTCTCAACAA | 62 | 283 |
| 780157 | 764 | 783 | 18663 | 18682 | ATTTCCTCTTCATCTTTAAA | 134 | 284 |
| 780158 | 808 | 827 | 18707 | 18726 | AAGGAATCGCTAGGGAATGT | 57 | 285 |
| 780159 | 852 | 871 | 21683 | 21702 | ATAACACCTGACATTGCCAC | 48 | 286 |
| 780160 | 878 | 897 | 21709 | 21728 | GCTTTCATAGCTTCCACCAC | 60 | 287 |
| 780161 | 881 | 900 | 21712 | 21731 | AATGCTTTCATAGCTTCCAC | 59 | 288 |
| 780162 | 885 | 904 | 21716 | 21735 | AGGGAATGCTTTCATAGCTT | 34 | 289 |
| 780163 | 888 | 907 | 21719 | 21738 | CATAGGGAATGCTTTCATAG | 99 | 290 |
| 780164 | 896 | 915 | 21727 | 21746 | CTTTCACTCATAGGGAATGC | 34 | 291 |
| 780165 | 940 | 959 | 21771 | 21790 | CTAATGTAAGCCTATGGAGC | 51 | 292 |
| 780166 | 988 | 1007 | 27963 | 27982 | CCACAAACTCATGGACTTCG | 30 | 293 |
| 780167 | 1032 | 1051 | 28007 | 28026 | GATCTGCAATGCTGCATTCT | 58 | 294 |
| 780168 | 1078 | 1097 | N/A | N/A | TTAAGAAAATAGTCTCAGTG | 160 | 70 |
| 780169 | 1123 | 1142 | 29384 | 29403 | CATCATCATTCTCTTGATTC | 63 | 295 |
| 780170 | 1167 | 1186 | 29428 | 29447 | TTTGTAACAGGCTTCCAGCC | 46 | 296 |
| 780171 | 1216 | 1235 | N/A | N/A | AGCATGCGGCCTCCTGCACG | 73 | 297 |
| 780172 | 1260 | 1279 | 29611 | 29630 | CTCATGTAAACTGTTTTGGT | 62 | 298 |
| 780173 | 1304 | 1323 | 31020 | 31039 | ACTTCCCTATGAGCTGGGAA | 134 | 299 |
| 780174 | 1348 | 1367 | 31064 | 31083 | GGAAAACTTCCTTTGATGAA | 91 | 300 |
| 780175 | 1417 | 1436 | 35364 | 35383 | TTGATAACAGTATTTTTCTG | 75 | 301 |
| 780176 | 1461 | 1480 | 35408 | 35427 | TATATGCTTCTGCATTAACT | 78 | 302 |
| 780177 | 1505 | 1524 | 35452 | 35471 | TGATTTAGCATTTTACAGCC | 106 | 303 |
| 780178 | 1549 | 1568 | 37598 | 37617 | CTGCTGCCATTATATCCAGG | 56 | 304 |
| 780179 | 1598 | 1617 | 37647 | 37666 | GGTAATGATGTCTCATGACG | 60 | 305 |
| 780180 | 1645 | 1664 | 37694 | 37713 | CAGGCACTATAAAATGTAAA | 93 | 306 |
| 780181 | 1689 | 1708 | 41922 | 41941 | CTTATGATGAAATTCTGTAT | 60 | 307 |
| 780182 | 1734 | 1753 | 41967 | 41986 | TTTGTGAATATCATTCTTGA | 52 | 308 |
| 780183 | 1779 | 1798 | 52693 | 52712 | AATCCCAGGATTTCCAATGA | 78 | 309 |
| 780184 | 1786 | 1805 | 52700 | 52719 | ATTTCTGAATCCCAGGATTT | 119 | 310 |
| 780185 | 1789 | 1808 | 52703 | 52722 | CACATTTCTGAATCCCAGGA | 41 | 311 |
| 780186 | 1793 | 1812 | 52707 | 52726 | AATCCACATTTCTGAATCCC | 70 | 312 |
| 780187 | 1796 | 1815 | 52710 | 52729 | TTTAATCCACATTTCTGAAT | 80 | 313 |
| 780188 | 1826 | 1845 | 52740 | 52759 | TCAGGAAAATGTACAATAGA | 128 | 314 |
| 780189 | 1873 | 1892 | 52787 | 52806 | GAAGCACTGAATCCATAGCA | 34 | 315 |
| 780190 | 1919 | 1938 | N/A | N/A | CCCAGACACTGAATTTCTTG | 56 | 37 |
| 780191 | 1963 | 1982 | 53003 | 53022 | TGAACACATTCTTCTTTGTA | 64 | 316 |
| 780192 | 2009 | 2028 | 53049 | 53068 | TATAAGCTGGAAACCAGAAT | 86 | 317 |
| 780193 | 2053 | 2072 | N/A | N/A | TCTGAAATCCTTTAGTCTGT | 106 | 318 |
| 780194 | 2097 | 2116 | 56031 | 56050 | CAGCTTAGAAAAAGATGCTG | 66 | 319 |

TABLE 3-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780195 | 2141 | 2160 | 56075 | 56094 | GACATTTGATGGAATATTAC | 45 | 320 |
| 780196 | 2185 | 2204 | N/A | N/A | AGAGGTTTAGAAACTGTTGA | 44 | 321 |
| 780197 | 2229 | 2248 | 56237 | 56256 | TTTTAAGTAATCATCCATAG | 70 | 322 |
| 780198 | 2273 | 2292 | 56281 | 56300 | ATGATGCTGTTATTCTGATC | 71 | 323 |
| 780199 | 2317 | 2336 | 56325 | 56344 | TTGCTTGATTGGCATCTGCT | 41 | 324 |
| 780200 | 2356 | 2375 | N/A | N/A | CTTTCTCACATACCTGACAA | 59 | 325 |
| 780201 | 2359 | 2378 | N/A | N/A | TCTCTTTCTCACATACCTGA | 50 | 326 |
| 780254 | 4111 | 4130 | 86606 | 86625 | GTTTCATTCGGTTATAAGGC | 36 | 235 |

TABLE 4

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693428 | 2361 | 2380 | 61982 | 62001 | GCTCTCTTTCTCACATACCT | 28 | 73 |
| 693430 | 5537 | 5556 | 100526 | 100545 | GCCCATTTCTTCAACAGAGT | 25 | 89 |
| 780254 | 4111 | 4130 | 86606 | 86625 | GTTTCATTCGGTTATAAGGC | 23 | 235 |
| 780276 | 4929 | 4948 | 93390 | 93409 | CTGTGCCATGATTTTACAAA | 62 | 327 |
| 780277 | 4973 | 4992 | 98121 | 98140 | CCCTTAGGGTGTTTTGGACA | 65 | 328 |
| 780278 | 5019 | 5038 | 98167 | 98186 | CCTTTTTTTTGAAAGAAATT | 154 | 329 |
| 780279 | 5063 | 5082 | 98211 | 98230 | TCTAGGAGCTTAAAATACTG | 112 | 330 |
| 780280 | 5109 | 5128 | 98257 | 98276 | AACCAGCAAATATTCTTCTC | 83 | 331 |
| 780281 | 5169 | 5188 | 99175 | 99194 | TTCAGAGTTCTCACAATGGG | 72 | 332 |
| 780282 | 5217 | 5236 | 99223 | 99242 | CCAAAATCCCATTGGAAAAT | 88 | 333 |
| 780283 | 5261 | 5280 | 99267 | 99286 | AGCATGTAAGGTGAAATCTC | 88 | 334 |
| 780284 | 5305 | 5324 | 100157 | 100176 | GCCAATACATTCTGTTTGGG | 25 | 335 |
| 780285 | 5349 | 5368 | 100201 | 100220 | CAGACAATAAGCTTCAGGAG | 82 | 336 |
| 780286 | 5396 | 5415 | 100248 | 100267 | ATTTTTAAGAAACTCTCTGA | 86 | 337 |
| 780287 | 5440 | 5459 | 100429 | 100448 | CTTGGCCCAAAAGAATACAG | 69 | 338 |
| 780288 | 5488 | 5507 | 100477 | 100496 | GCAACCCAGGAAACCATTCT | 83 | 339 |
| 780289 | 5532 | 5551 | 100521 | 100540 | TTTCTTCAACAGAGTTTCTC | 157 | 340 |
| 780290 | 5535 | 5554 | 100524 | 100543 | CCATTTCTTCAACAGAGTTT | 64 | 341 |
| 780291 | 5539 | 5558 | 100528 | 100547 | ATGCCCATTTCTTCAACAGA | 59 | 342 |
| 780292 | 5542 | 5561 | 100531 | 100550 | ATAATGCCCATTTCTTCAAC | 135 | 343 |
| 780293 | 5577 | 5596 | 100566 | 100585 | GATTTTTTGATGTTCTTCAC | 64 | 344 |
| 780294 | 5622 | 5641 | N/A | N/A | TAAGAGATCTCCTTCCTCTG | 77 | 345 |
| 780295 | 5666 | 5685 | 101304 | 101323 | ATCTGAGATATTGGAATGGT | 86 | 346 |
| 780296 | 5710 | 5729 | 101348 | 101367 | ACATAATATTTCTAGGCAGG | 48 | 347 |
| 780297 | 5754 | 5773 | 101392 | 101411 | GAGAAACTCTGGAGCTTGTT | 138 | 348 |
| 780298 | 5798 | 5817 | 106489 | 106508 | TCATAGGCTGCTCGGTAAAC | 109 | 349 |
| 780299 | 5842 | 5861 | 106533 | 106552 | GTGATGTATGTTTATTAAAA | 88* | 350 |
| 780300 | 5886 | 5905 | 113083 | 113102 | GTGGAGGTGGCAAAGCACCA | 50* | 351 |
| 780301 | 5946 | 5965 | 113143 | 113162 | CTCCATCACCAACATCCGGG | 121 | 352 |
| 780302 | 5990 | 6009 | 113187 | 113206 | TTGTCCTGCTGAAGCAGGCG | 136 | 353 |
| 780303 | 6034 | 6053 | 113231 | 113250 | CGTGGAGTGCAATCCTGTGC | 89 | 354 |
| 780304 | 6078 | 6097 | 118411 | 118430 | GTATATAATCATGGCTGAGT | 68 | 355 |
| 780305 | 6122 | 6141 | 118455 | 118474 | GGATACAGTGTGAAAAGCAG | 61 | 356 |
| 780306 | 6166 | 6185 | 118499 | 118518 | GAGCAATGCCGTAGTCAGCA | 61 | 357 |
| 780307 | 6170 | 6189 | 118503 | 118522 | TACTGAGCAATGCCGTAGTC | 75 | 358 |
| 780308 | 6173 | 6192 | 118506 | 118525 | CAGTACTGAGCAATGCCGTA | 61 | 359 |
| 780309 | 6175 | 6194 | 118508 | 118527 | AGCAGTACTGAGCAATGCCG | 58 | 360 |
| 780310 | 6177 | 6196 | 118510 | 118529 | ACAGCAGTACTGAGCAATGC | 70 | 361 |
| 780311 | 6180 | 6199 | 118513 | 118532 | TCTACAGCAGTACTGAGCAA | 88 | 362 |
| 780312 | 6211 | 6230 | 118544 | 118563 | CTGGTGTGCCCTCTGATGTT | 97 | 363 |
| 780313 | 6255 | 6274 | 124886 | 124905 | GTTATAAATGACATTTCCTC | 77 | 364 |
| 780314 | 6299 | 6318 | 124930 | 124949 | ATGTCATAGAGTAGTAAACC | 111 | 365 |
| 780315 | 6345 | 6364 | 124976 | 124995 | ATTTGGAAACTTCAAACCCT | 60 | 366 |
| 780316 | 6389 | 6408 | N/A | N/A | ACTGGATCAGGTAATTTTCC | 62 | 367 |
| 780317 | 6433 | 6452 | 126549 | 126568 | TTAATTTCTCAACCATAGGC | 120 | 368 |
| 780318 | 6477 | 6496 | 126593 | 126612 | AGAAGTAGGCCTTTCTTGAG | 95 | 369 |
| 780319 | 6521 | 6540 | 129666 | 129685 | AGACAGACTAATTCAGCTGA | 78 | 370 |
| 780320 | 6568 | 6587 | 129713 | 129732 | CCATGCATTCAACAATTACG | 57 | 371 |

TABLE 4-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780321 | 6612 | 6631 | 129757 | 129776 | GCCCAGCCAAATGCTTGCAT | 41 | 372 |
| 780322 | 6656 | 6675 | 129801 | 129820 | TTTAAGTCAAGAAATGAGAG | 92 | 373 |
| 780323 | 6700 | 6719 | 132410 | 132429 | ATATTCTACTATCAGCAACT | 97 | 374 |
| 780324 | 6744 | 6763 | 132454 | 132473 | CCAGCTTTCCTTTTCAACAG | 132 | 375 |
| 780325 | 6788 | 6807 | 132498 | 132517 | GTATTGATGACCAGGAGAGT | 92 | 376 |
| 780326 | 6832 | 6851 | 132542 | 132561 | AATCAGTCATCTTTTCTAGG | 98 | 377 |
| 780327 | 6876 | 6895 | N/A | N/A | TTTGCTTTGCTTGGAAAAGG | 85 | 378 |
| 780328 | 6920 | 6939 | 134252 | 134271 | GCTAACTTGCCATCAGCGGT | 84 | 379 |
| 780329 | 6964 | 6983 | 137368 | 137387 | AAGGAGCAGCTCCTTTAAGC | 65 | 380 |
| 780330 | 7008 | 7027 | 137412 | 137431 | ACACATCAATGGAGTACTGA | 51 | 381 |
| 780331 | 7052 | 7071 | 137456 | 137475 | CCCCACATTACATTTCTTTC | 124 | 382 |
| 780332 | 7096 | 7115 | 137500 | 137519 | TGGTGAAATCATTAGAAAAG | 119 | 383 |
| 780333 | 7141 | 7160 | N/A | N/A | CATAAGAAAACAGTTGGCTT | 61 | 384 |
| 780334 | 7185 | 7204 | 141546 | 141565 | AGTGTCTACCACCACTGTTA | 124 | 385 |
| 780335 | 7229 | 7248 | 141590 | 141609 | CACACTTCCACAACAGGGCT | 116 | 386 |
| 780336 | 7273 | 7292 | 141634 | 141653 | GCACGCAGTCTATTAGTCCA | 60 | 387 |
| 780337 | 7318 | 7337 | 142966 | 142985 | GTTTTGATTCCTTGTTTTCT | 92 | 388 |
| 780338 | 7362 | 7381 | 143010 | 143029 | CTGAAGGCAGAGGGTTTTCA | 78 | 389 |
| 780339 | 7406 | 7425 | 143054 | 143073 | AAAATATGGCCTCCTCCAGT | 82 | 390 |
| 780340 | 7457 | 7476 | 143105 | 143124 | CAAAAGTTGTAAATTACACG | 77 | 391 |
| 780341 | 7501 | 7520 | N/A | N/A | TAAGGCTTCCTAGCTGTGCT | 89 | 392 |
| 780342 | 7545 | 7564 | 145148 | 145167 | TTCAGTATTTTTCCGGTTGT | 121 | 393 |
| 780343 | 7589 | 7608 | 145758 | 145777 | CAAACGGTCAAGCAAGATTG | 138 | 394 |
| 780344 | 7636 | 7655 | 145805 | 145824 | CAATGTGTTTTTCTAAATTT | 102 | 395 |
| 780345 | 7688 | 7707 | 145857 | 145876 | TCTTACTCAACAGATGTTCG | 92 | 396 |
| 780346 | 7732 | 7751 | 145901 | 145920 | GAGGAGAGAATAATTTTCCT | 91 | 397 |
| 780347 | 7776 | 7795 | 145945 | 145964 | GAGTACCCTTTCCATGTGAA | 34 | 398 |
| 780348 | 7822 | 7841 | 145991 | 146010 | AAAATAATAACATTCCTTCA | 96 | 399 |
| 780349 | 7867 | 7886 | 146036 | 146055 | AAAATACACATTTACTGGTA | 115 | 400 |
| 780350 | 7912 | 7931 | 146081 | 146100 | CTGGTATTTATAAGAAATAT | 91 | 401 |
| 780351 | 7960 | 7979 | 146129 | 146148 | ATTAGGTACTTCACAGATTT | 140 | 402 |

TABLE 5

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693428 | 2361 | 2380 | 61982 | 62001 | GCTCTCTTTCTCACATACCT | 30 | 73 |
| 780254 | 4111 | 4130 | 86606 | 86625 | GTTTCATTCGGTTATAAGGC | 39 | 235 |
| 780352 | 8004 | 8023 | 146173 | 146192 | AACAAAAAATTATCGGCCTT | 79 | 403 |
| 780353 | 8052 | 8071 | 146221 | 146240 | CTTAAGCACAGAATTTAAAA | 94 | 404 |
| 780354 | 8096 | 8115 | 146265 | 146284 | ATACCGTGCAGATTTCTAGA | 91 | 405 |
| 780355 | 8140 | 8159 | 146309 | 146328 | AAGAAGGAATACATTACATG | 148 | 406 |
| 780356 | 8186 | 8205 | 146355 | 146374 | TTTGAATATTTACAAGCATA | 163 | 407 |
| 780357 | 8201 | 8220 | 146370 | 146389 | ATTAGTGCAAATTCATTTGA | 79 | 408 |
| 780358 | 8206 | 8225 | 146375 | 146394 | ACTTTATTAGTGCAAATTCA | 118 | 409 |
| 780359 | 8211 | 8230 | 146380 | 146399 | AAAGGACTTTATTAGTGCAA | 48 | 410 |
| 780360 | 8216 | 8235 | 146385 | 146404 | CCAACAAAGGACTTTATTAG | 75 | 411 |
| 780361 | 8221 | 8240 | 146390 | 146409 | ACATACCAACAAAGGACTTT | 98 | 412 |
| 780362 | 8231 | 8250 | 146400 | 146419 | AAGAGAATTCACATACCAAC | 164 | 413 |
| 780363 | 8275 | 8294 | 146444 | 146463 | AATTGAGTGAAGTTGTGTAA | 133 | 414 |
| 780364 | 8319 | 8338 | 146488 | 146507 | ATGTCATGTTTTTTCATTAG | 157 | 415 |
| 780365 | 8364 | 8383 | 146533 | 146552 | AAAGAGAGTTTCTGTGTCTT | 146 | 416 |
| 780366 | 8408 | 8427 | 146577 | 146596 | ACAACTCTATTATGTCTAGG | 161 | 417 |
| 780367 | 8452 | 8471 | 146621 | 146640 | TATACAAAATTCAGGGTATC | 94 | 418 |
| 780368 | 8515 | 8534 | 146684 | 146703 | TAGTGGTATGAATAAAAAAA | 107 | 419 |
| 780369 | 8561 | 8580 | 146730 | 146749 | AGATGAATATAAGCATTAGA | 98 | 420 |
| 780370 | 8605 | 8624 | 146774 | 146793 | TATCTGAATGATGTAGGATC | 118 | 421 |
| 780371 | 8650 | 8669 | 146819 | 146838 | GTAGGAGCTGTGGAATTCTA | 125 | 422 |
| 780372 | 8694 | 8713 | 146863 | 146882 | CTTCAGCAACTGAAAAGTGT | 132 | 423 |
| 780373 | 8741 | 8760 | 146910 | 146929 | CTAGGGTGGCAGATATTTTT | 126 | 424 |
| 780374 | 8785 | 8804 | 146954 | 146973 | TATTGTGGTAAGCTATGTAA | 106 | 425 |

TABLE 5-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780375 | 8829 | 8848 | 146998 | 147017 | AAATGACCTCAAATTATTAC | 84 | 426 |
| 780376 | 8873 | 8892 | 147042 | 147061 | GGTCAGGGCCAAAGAATTTA | 130 | 427 |
| 780377 | 8917 | 8936 | 147086 | 147105 | ACTAGTTGTCCTATCACAGG | 81 | 428 |
| 780378 | 8962 | 8981 | 147131 | 147150 | GTTTTCACATAGTAAAATGC | 47 | 429 |
| 780379 | 9006 | 9025 | 147175 | 147194 | TCATCTTTAAGAATTTGATT | 94 | 430 |
| 780380 | 9050 | 9069 | 147219 | 147238 | ATAACAAGTTAAAGCATAGC | 58 | 431 |
| 780381 | 9094 | 9113 | 147263 | 147282 | CTGGAACAAAGAGCTCTATT | 97 | 432 |
| 780382 | 9143 | 9162 | 147312 | 147331 | CTTTGGTAAAAAAAATTGCA | 125 | 433 |
| 780383 | 9183 | 9202 | 147352 | 147371 | ATTATTCCATTTAAATATGG | 125 | 434 |
| 780384 | 9188 | 9207 | 147357 | 147376 | CCTTTATTATTCCATTTAAA | 77 | 435 |
| 780385 | 9193 | 9212 | 147362 | 147381 | AAAAACCTTTATTATTCCAT | 93 | 436 |
| 780386 | N/A | N/A | 82225 | 82244 | CCTCTTTCAGTTTATTGTGA | 87 | 437 |
| 780387 | N/A | N/A | 82365 | 82384 | ATAGTTGACAGGAATTTATA | 71 | 438 |
| 780388 | N/A | N/A | 82505 | 82524 | GTTTAGTGGAAGTATTAAGG | 51 | 439 |
| 780389 | N/A | N/A | 82645 | 82664 | TATATGATAACATCACACAT | 106 | 440 |
| 780390 | N/A | N/A | 82785 | 82804 | TTCCATAGAACACTCTTTAT | 219 | 441 |
| 780391 | N/A | N/A | 82925 | 82944 | AGGAAATTATGCTGTGTTAC | 108 | 442 |
| 780392 | N/A | N/A | 83065 | 83084 | AGAAAAATGGTTTATTTAAG | 96 | 443 |
| 780394 | N/A | N/A | 79043 | 79062 | ACACTGACCATACACAAGCT | 100 | 444 |
| 780395 | N/A | N/A | 143142 | 143161 | GCCTAGCTGTGCTGTCATCA | 126 | 445 |
| 780396 | N/A | N/A | 143282 | 143301 | TACCAGTCTTATGTTTCACT | 108 | 446 |
| 780397 | N/A | N/A | 143422 | 143441 | ATTTCCCATTTTTGCCTTAG | 62 | 447 |
| 780398 | N/A | N/A | 143565 | 143584 | TGTATTGCTGCAAGAAAAAA | 90 | 448 |
| 780399 | N/A | N/A | 143705 | 143724 | ACGCAAATATATTTATGCAG | 74 | 449 |
| 780400 | N/A | N/A | 143845 | 143864 | ATGTTCAAAACATTCATTAT | 137 | 450 |
| 780401 | N/A | N/A | 143985 | 144004 | TAATAGTTTACAGTCATTAA | 111 | 451 |
| 780402 | N/A | N/A | 144125 | 144144 | TATAACTTCAGTTATAAGCA | 92 | 452 |
| 780403 | N/A | N/A | 144265 | 144284 | AGACAAGCAAGATCTGGTAG | 118 | 453 |
| 780404 | N/A | N/A | 144405 | 144424 | ACAGGAGCTAACATTTCAAA | 123 | 454 |
| 780405 | N/A | N/A | 144553 | 144572 | AACCGTCTTGGAGTTTATAT | 56 | 455 |
| 780406 | N/A | N/A | 144694 | 144713 | TATACTGATACTATGTCAAA | 193 | 456 |
| 780407 | N/A | N/A | 144834 | 144853 | CAGTATTTATACATTACCCT | 150 | 457 |
| 780408 | N/A | N/A | 144974 | 144993 | TTTTCTAGGTGACCCTTCAA | 119 | 458 |
| 780409 | N/A | N/A | 145168 | 145187 | CCTTTCTGCTTTTGTGTACC | 93 | 459 |
| 780410 | N/A | N/A | 145310 | 145329 | AAGTTCTTTACACTATAAAC | 112 | 460 |
| 780411 | N/A | N/A | 145450 | 145469 | GACATTATGTAGATATAGAT | 80 | 461 |
| 780412 | N/A | N/A | 145597 | 145616 | ATTATTATTTATAAAAAACT | 124 | 462 |
| 780413 | N/A | N/A | 145740 | 145759 | TGTATCTCTAGAAAAAGAAA | 111 | 463 |
| 780414 | N/A | N/A | 3862 | 3881 | AATCACAGTCAGAGGTTCCT | 120 | 464 |
| 780415 | N/A | N/A | 4122 | 4141 | CCCTTTTCCAAACTATTCAT | 119 | 465 |
| 780416 | N/A | N/A | 4157 | 4176 | GTGACAAAGTTGCATTTTAT | 108 | 466 |
| 780417 | N/A | N/A | 4174 | 4193 | TCTACAAGAGTTTGCTAGTG | 97 | 467 |
| 780418 | N/A | N/A | 4185 | 4204 | AAGTGCTGAACTCTACAAGA | 134 | 468 |
| 780419 | N/A | N/A | 6986 | 7005 | CTCTCACTTCGCTATGACAG | 116 | 469 |
| 780420 | N/A | N/A | 7557 | 7576 | AACCGTCAATTTTCTAAAGA | 110 | 470 |
| 780421 | N/A | N/A | 7842 | 7861 | CTATTCAATTAAAAGCTTAT | 122 | 471 |
| 780422 | N/A | N/A | 8002 | 8021 | CTCAAGGAAAAAACCTGTTT | 125 | 472 |
| 780423 | N/A | N/A | 8263 | 8282 | AAAGGCGGCAATTTCTGATA | 130 | 473 |
| 780424 | N/A | N/A | 8791 | 8810 | TATACTTGACATGGTCAAAA | 177 | 474 |
| 780425 | N/A | N/A | 8820 | 8839 | CTCCAATTCATTCTATTATA | 89 | 475 |
| 780426 | N/A | N/A | 11028 | 11047 | AACATAGCTGGTAAAATTAC | 143 | 476 |
| 780427 | N/A | N/A | 11977 | 11996 | AAACATTCAATGAATAGAAG | 86 | 477 |
| 780428 | N/A | N/A | 12155 | 12174 | ACGGAAGAAATTTTTCTTCA | 116 | 478 |

TABLE 6

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693428 | 2361 | 2380 | 61982 | 62001 | GCTCTCTTTCTCACATACCT | 38 | 73 |
| 780254 | 4111 | 4130 | 86606 | 86625 | GTTTCATTCGGTTATAAGGC | 18 | 235 |
| 780429 | N/A | N/A | 12244 | 12263 | CCAGTCTTCGATTCTCTGCC | 135 | 479 |

TABLE 6-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780430 | N/A | N/A | 12353 | 12372 | TTGGCTTTACATTATTGGAA | 41 | 480 |
| 780431 | N/A | N/A | 12761 | 12780 | GTGGCCGTTGCTCACGCCTG | 130 | 481 |
| 780432 | N/A | N/A | 12910 | 12929 | TCTTAGACATGTTGATATAT | 136 | 482 |
| 780433 | N/A | N/A | 14791 | 14810 | TCTTAGCAGGACTGATGAGG | 75 | 483 |
| 780434 | N/A | N/A | 15592 | 15611 | CAAATCAATTCATTACCAAG | 91 | 484 |
| 780435 | N/A | N/A | 15874 | 15893 | GCTCTAGATCTTTATAAATG | 102 | 485 |
| 780436 | N/A | N/A | 16258 | 16277 | TACTTTTCCCAGTATAAGCC | 114 | 486 |
| 780437 | N/A | N/A | 16448 | 16467 | CCTTATGCCTTGTTAAGCAA | 84 | 487 |
| 780438 | N/A | N/A | 16899 | 16918 | GAAATTAGACTGGTAAACTG | 113 | 488 |
| 780439 | N/A | N/A | 16920 | 16939 | ATCCCATTCTGGGAACTGCA | 61 | 489 |
| 780440 | N/A | N/A | 17294 | 17313 | TTGTATTCCTTGCAAAATGT | 123 | 490 |
| 780441 | N/A | N/A | 17451 | 17470 | TTAGTTGCAAGATAGAACAT | 82 | 491 |
| 780442 | N/A | N/A | 17796 | 17815 | ATGGTCTAGTTTCCACAGTA | 44 | 492 |
| 780443 | N/A | N/A | 18025 | 18044 | AGTAAGTTCCATTTGGAGTC | 61 | 493 |
| 780444 | N/A | N/A | 18279 | 18298 | GGGAAATTCTAGAGAAAACT | 64 | 494 |
| 780445 | N/A | N/A | 18439 | 18458 | TGTGAAGCAGCCCTTCCTAA | 128 | 495 |
| 780446 | N/A | N/A | 19114 | 19133 | ACTTCAGGTCACACCTTCAT | 66 | 496 |
| 780447 | N/A | N/A | 19502 | 19521 | CACATCAAATTAATTTCTTC | 95 | 497 |
| 780448 | N/A | N/A | 19553 19583 | 19572 19602 | AAACAGAATATGAACCATTA | 129 | 498 |
| 780449 | N/A | N/A | 19556 19586 | 19575 19605 | ACAAAACAGAATATGAACCA | 71 | 499 |
| 780450 | N/A | N/A | 19559 19589 | 19578 19608 | AAAACAAAACAGAATATGAA | 143 | 500 |
| 780451 | N/A | N/A | 19562 19592 | 19581 19611 | TACAAAACAAAACAGAATAT | 190 | 501 |
| 780452 | N/A | N/A | 19953 | 19972 | TGTGGATAAGAAAACATTGT | 119 | 502 |
| 780453 | N/A | N/A | 20195 | 20214 | TCTTGACTTTTGCATTATGA | 76 | 503 |
| 780454 | N/A | N/A | 20454 22583 | 20473 22602 | AAATGTTAACTGTTCTTTTT | 60 | 504 |
| 780455 | N/A | N/A | 20713 | 20732 | TCAGCTATGACCTGTTTCCT | 34 | 505 |
| 780456 | N/A | N/A | 20716 | 20735 | AAATCAGCTATGACCTGTTT | 128 | 506 |
| 780457 | N/A | N/A | 21493 | 21512 | GTAAAAAATACTATGCTGTT | 87 | 507 |
| 780458 | N/A | N/A | 22339 | 22358 | CAAACATTAACAATTTTGCT | 118 | 508 |
| 780459 | N/A | N/A | 23396 | 23415 | ACCTCTAATAAATTGTGCTG | 73 | 509 |
| 780460 | N/A | N/A | 23640 | 23659 | GCATGGAATAGTAAAGGCCC | 61 | 510 |
| 780461 | N/A | N/A | 23970 | 23989 | ATTGCTAGGTAGAGAACTTA | 50 | 511 |
| 780462 | N/A | N/A | 24452 | 24471 | TCTAATAAATGACCAAGTTA | 76 | 512 |
| 780463 | N/A | N/A | 24633 | 24652 | GAACTTTATATATAGTTATC | 92 | 513 |
| 780464 | N/A | N/A | 24916 | 24935 | CTTGTGGGAAAGCATGAATC | 67 | 514 |
| 780465 | N/A | N/A | 25082 | 25101 | TCCAACAGTTAACGATCATT | 51 | 515 |
| 780466 | N/A | N/A | 25273 | 25292 | GATATAATCATGATACTAGA | 57 | 516 |
| 780467 | N/A | N/A | 25433 | 25452 | CAGTTTTAGTCATATAACAA | 108 | 517 |
| 780468 | N/A | N/A | 25435 | 25454 | TACAGTTTTAGTCATATAAC | 155 | 518 |
| 780469 | N/A | N/A | 25637 25667 25697 25727 | 25656 25686 25716 25746 | ATATGTATATTTATATACAT | 171 | 519 |
| 780470 | N/A | N/A | 25640 25670 25700 25730 25794 25858 | 25659 25689 25719 25749 25813 25877 | TAAATATGTATATTTATATA | 149 | 520 |
| 780471 | N/A | N/A | 25643 25673 25703 25733 25797 25861 | 25662 25692 25722 25752 25816 25880 | GTATAAATATGTATATTTAT | 163 | 521 |
| 780472 | N/A | N/A | 25646 25676 25706 25736 25800 25864 | 25665 25695 25725 25755 25819 25883 | TGTGTATAAATATGTATATT | 96 | 522 |

TABLE 6-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780473 | N/A | N/A | 25649 25679 25709 25739 25803 25867 | 25668 25698 25728 25758 25822 25886 | ATCTGTGTATAAATATGTAT | 106 | 523 |
| 780474 | N/A | N/A | 25652 25682 25712 25742 25806 25870 | 25671 25701 25731 25761 25825 25889 | TACATCTGTGTATAAATATG | 138 | 524 |
| 780475 | N/A | N/A | 25655 25685 25715 25745 25809 25873 | 25674 25704 25734 25764 25828 25892 | ATATACATCTGTGTATAAAT | 179 | 525 |
| 780476 | N/A | N/A | 25658 25688 25718 25748 25812 25876 | 25677 25707 25737 25767 25831 25895 | TTTATATACATCTGTGTATA | 129 | 526 |
| 780477 | N/A | N/A | 25661 25691 25721 25751 25815 25879 | 25680 25710 25740 25770 25834 25898 | ATATTTATATACATCTGTGT | 66 | 527 |
| 780478 | N/A | N/A | 25664 25694 25724 25754 25818 25882 | 25683 25713 25743 25773 25837 25901 | TGTATATTTATATACATCTG | 55 | 528 |
| 780479 | N/A | N/A | 25755 25819 25883 | 25774 25838 25902 | TTGTATATTTATATACATCT | 88 | 529 |
| 780480 | N/A | N/A | 25758 25822 25886 | 25777 25841 25905 | TATTTGTATATTTATATACA | 164 | 530 |
| 780481 | N/A | N/A | 25761 25825 25889 | 25780 25844 25908 | TTATATTTGTATATTTATAT | 156 | 531 |
| 780482 | N/A | N/A | 25764 25828 25892 | 25783 25847 25911 | TATTTATATTTGTATATTTA | 178 | 532 |
| 780483 | N/A | N/A | 25767 25831 25895 | 25786 25850 25914 | ATATATTTATATTTGTATAT | 96 | 533 |
| 780484 | N/A | N/A | 25770 25834 25898 | 25789 25853 25917 | TGTATATATTTATATTTGTA | 110 | 534 |
| 780485 | N/A | N/A | 25773 25837 25901 | 25792 25856 25920 | AAATGTATATATTTATATTT | 102 | 535 |
| 780486 | N/A | N/A | 25776 25840 25904 | 25795 25859 25923 | TATAAATGTATATATTTATA | 144 | 536 |
| 780487 | N/A | N/A | 25779 25843 25907 | 25798 25862 25926 | ATATATAAATGTATATATTT | 122 | 537 |
| 780488 | N/A | N/A | 25782 25846 25910 | 25801 25865 25929 | TTTATATATAAATGTATATA | 106 | 538 |
| 780489 | N/A | N/A | 25785 25849 25913 | 25804 25868 25932 | ATATTTATATATAAATGTAT | 139 | 539 |

TABLE 6-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780490 | N/A | N/A | 25788 | 25807 | TGTATATTTATATATAAATG | 98 | 540 |
|  |  |  | 25852 | 25871 |  |  |  |
| 780491 | N/A | N/A | 25791 | 25810 | ATATGTATATTTATATATAA | 110 | 541 |
|  |  |  | 25855 | 25874 |  |  |  |
| 780492 | N/A | N/A | 26102 | 26121 | CCATGTTTAGAAGAAATACT | 57 | 542 |
| 780493 | N/A | N/A | 26738 | 26757 | ATTACATAGTTTGGCAAAAC | 107 | 543 |
| 780494 | N/A | N/A | 27287 | 27306 | ACTGCAGAAATATGTACCTT | 89 | 544 |
| 780495 | N/A | N/A | 27387 | 27406 | CACCCCAGGAAGAAGTCCCA | 100 | 545 |
| 780496 | N/A | N/A | 27872 | 27891 | GTTAAATTACCTTTAACATA | 174 | 546 |
| 780497 | N/A | N/A | 28186 | 28205 | TCCTTGAAAGTATCCTCTAC | 90 | 547 |
| 780498 | N/A | N/A | 29148 | 29167 | CCATCCTATCCAGATAAATA | 137 | 548 |
| 780499 | N/A | N/A | 29220 | 29239 | AGGTGTGCTTTAGGAGAAGC | 34 | 549 |
| 780500 | N/A | N/A | 32958 | 32977 | TTATTAAGGCAGAACTCCAA | 92 | 550 |
| 780501 | N/A | N/A | 33224 | 33243 | CATCCCAAGTGCCTACAGAC | 146 | 551 |
| 780502 | N/A | N/A | 34124 | 34143 | ACTTTGAAAGTGGCAGAAAA | 125 | 552 |
| 780503 | N/A | N/A | 34685 | 34704 | TTACAGTTATTTTCACAAAG | 89 | 553 |
| 780504 | N/A | N/A | 34756 | 34775 | CAAACATTATAATTTCTATA | 195 | 554 |
| 780505 | N/A | N/A | 34881 | 34900 | TATAAGCATGTGGAGGTATC | 90 | 555 |

TABLE 7

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693428 | 2361 | 2380 | 61982 | 62001 | GCTCTCTTTCTCACATACCT | 49 | 73 |
| 780254 | 4111 | 4130 | 86606 | 86625 | GTTTCATTCGGTTATAAGGC | 33 | 235 |
| 780506 | N/A | N/A | 35751 | 35770 | TGCTATGTGCTATACAATTA | 75 | 556 |
| 780507 | N/A | N/A | 36381 | 36400 | CTTACAAGTCTGCAGTTACG | 72 | 557 |
| 780508 | N/A | N/A | 36600 | 36619 | TGCCCAGAATCTACAGAATC | 99 | 558 |
| 780509 | N/A | N/A | 36661 | 36680 | TCCAGGGCTGCAACTGTACA | 107 | 559 |
| 780510 | N/A | N/A | 36909 | 36928 | GTTCTGTGGACACTGAGATA | 91 | 560 |
| 780511 | N/A | N/A | 36965 | 36984 | GCTTTGCTTGTTAACTGAAA | 66 | 561 |
| 780512 | N/A | N/A | 37065 | 37084 | TTTCTCTCAGGTATTTAAGC | 74 | 562 |
| 780513 | N/A | N/A | 37116 | 37135 | GACTTCTTATAAGGTATTTT | 65 | 563 |
| 780514 | N/A | N/A | 37198 | 37217 | GGCTGGTACCCAAACTTGTC | 91 | 564 |
| 780515 | N/A | N/A | 37201 | 37220 | CAAGGCTGGTACCCAAACTT | 72 | 565 |
| 780516 | N/A | N/A | 37303 | 37322 | ACAATCCCAGCAGGTAGGTG | 57 | 566 |
| 780517 | N/A | N/A | 37333 | 37352 | ATCCTTCTGACCTACGATGG | 72 | 567 |
| 780518 | N/A | N/A | 37398 | 37417 | CTTTGAACTCATAAGATAGA | 83 | 568 |
| 780519 | N/A | N/A | 37548 | 37567 | GCTTATTGAAAGACTGATCT | 88 | 569 |
| 780520 | N/A | N/A | 38071 | 38090 | GAAGGAAGAGAACAGGTATG | 94 | 570 |
| 780521 | N/A | N/A | 38396 | 38415 | CGCCTCTCTCACGCTGCCTG | 92 | 571 |
| 780522 | N/A | N/A | 38720 | 38739 | TGCAAACAATTTTAATAAAC | 96 | 572 |
| 780523 | N/A | N/A | 38837 | 38856 | TGACTACCATGGACCTCCAA | 83 | 573 |
| 780524 | N/A | N/A | 38855 | 38874 | CCTTCACTGGGTCTCACTTG | 91 | 574 |
| 780525 | N/A | N/A | 39213 | 39232 | ACTAAGCTGAAACTATGAAT | 104 | 575 |
| 780526 | N/A | N/A | 39521 | 39540 | CTGATTGATTGTTAACTAAC | 79 | 576 |
| 780527 | N/A | N/A | 40301 | 40320 | TTATAAGTAAGTAGATTTGA | 111 | 577 |
| 780528 | N/A | N/A | 40577 | 40596 | AGATTGTTGCACAAATATTT | 95 | 578 |
| 780529 | N/A | N/A | 40733 | 40752 | TACTATTCAAATGGATATAA | 116 | 579 |
| 780530 | N/A | N/A | 41316 | 41335 | GAACTATGCTAAAAACACTA | 90 | 580 |
| 780531 | N/A | N/A | 41593 | 41612 | TTTTGTGTGAGTAGGCTGTG | 83 | 581 |
| 780532 | N/A | N/A | 42005 | 42024 | TATATTCAACATACCCTGTT | 100 | 582 |
| 780533 | N/A | N/A | 43265 | 43284 | TACAACATAAATTCTTGCCA | 57 | 583 |
| 780534 | N/A | N/A | 45337 | 45356 | AATCTTACTGTCAATATAGT | 101 | 584 |
| 780535 | N/A | N/A | 45380 | 45399 | TTAAAAGGAAGTAACCATGT | 44 | 585 |
| 780536 | N/A | N/A | 45462 | 45481 | TGGTATCCCTCCTAAGTGCT | 55 | 586 |
| 780537 | N/A | N/A | 45650 | 45669 | CTCTCTTGGCTCCCGACTGC | 75 | 587 |
| 780538 | N/A | N/A | 46047 | 46066 | TACCTTATTTGGAACTCTGC | 86 | 588 |
| 780539 | N/A | N/A | 46543 | 46562 | TTACTTATATGTAATTTGTT | 77 | 589 |
| 780540 | N/A | N/A | 46567 | 46586 | CATCCTGTAAACCTTTTTTA | 79 | 590 |
| 780541 | N/A | N/A | 47702 | 47721 | AAAGATTAAATTAAGCTGCA | 121 | 591 |

TABLE 7-continued

Percent control of human LRRK2 RNA with 5-10-5 MOE
gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780542 | N/A | N/A | 47812 | 47831 | ACATTAGGAATCTCACCTCA | 71 | 592 |
| 780543 | N/A | N/A | 48404 | 48423 | CTGAATATAAATATTATCTA | 229 | 593 |
| 780544 | N/A | N/A | 48835 | 48854 | ATGTATAGCTAGAATGAGGA | 99 | 594 |
| 780545 | N/A | N/A | 48873 | 48892 | AGATGCAACTCAAGAAAACT | 81 | 595 |
| 780546 | N/A | N/A | 48947 | 48966 | TATTTATAAAGCACCTATCT | 85 | 596 |
|  |  |  | 50077 | 50096 |  |  |  |
| 780547 | N/A | N/A | 50094 | 50113 | AAATTATATCAAATTGATAT | 73 | 597 |
| 780548 | N/A | N/A | 51550 | 51569 | TTTTATAGAGGCTGAGGAGA | 98 | 598 |
| 780549 | N/A | N/A | 52154 | 52173 | GCCAAACTTTAAAGATGCAG | 33 | 599 |
| 780550 | N/A | N/A | 53367 | 53386 | CGAATAAACTCAGCTAGCTG | 87 | 600 |
| 780551 | N/A | N/A | 53543 | 53562 | GACAGTTATTATATATCATG | 42 | 601 |
| 780552 | N/A | N/A | 53603 | 53622 | AAATTTATTCTTAATCTCCC | 79 | 602 |
| 780553 | N/A | N/A | 54774 | 54793 | AAAACAAGTGAATGCTACAG | 92 | 603 |
| 780554 | N/A | N/A | 54886 | 54905 | CTCTTATGATGCTGAGTATC | 108 | 604 |
| 780555 | N/A | N/A | 55333 | 55352 | ATGTTTTAATGAAAGATTGG | 86 | 605 |
| 780556 | N/A | N/A | 55870 | 55889 | TTAACTATAGATATATTGGG | 80 | 606 |
| 780557 | N/A | N/A | 55936 | 55955 | GGCAAAATGAATAAACAGTA | 94 | 607 |
| 780558 | N/A | N/A | 56363 | 56382 | TTGAATATTTACCTGACAAA | 107 | 608 |
| 780559 | N/A | N/A | 56837 | 56856 | AGTGTTACACAACTTTGGCC | 120 | 609 |
| 780560 | N/A | N/A | 56947 | 56966 | GAGGGCTTTAAAGAAAGATA | 97 | 610 |
| 780561 | N/A | N/A | 57738 | 57757 | TGTAGTACAGTTGTATCAGG | 84 | 611 |
| 780562 | N/A | N/A | 57907 | 57926 | TAAACCTAATACATAATCCT | 81 | 612 |
| 780563 | N/A | N/A | 57911 | 57930 | TCTTTAAACCTAATACATAA | 102 | 613 |
| 780564 | N/A | N/A | 59330 | 59349 | ATTAGAACCTACTGGACCTT | 89 | 614 |
| 780565 | N/A | N/A | 60045 | 60064 | TTTTCTCTAAGATATGCCAT | 78 | 615 |
| 780566 | N/A | N/A | 60338 | 60357 | GCTCATAGCAAAATTAAAAG | 109 | 616 |
| 780567 | N/A | N/A | 60503 | 60522 | TTTCATTTAATGTAGCACTG | 101 | 617 |
| 780568 | N/A | N/A | 61046 | 61065 | AGCAACTGAGACTTGGATTT | 91 | 618 |
| 780569 | N/A | N/A | 62829 | 62848 | ACATTTAGTGTGAACAAATG | 77 | 619 |
| 780570 | N/A | N/A | 62985 | 63004 | TGCTAGTGAGTGCATCATAA | 120 | 620 |
| 780571 | N/A | N/A | 63074 | 63093 | TGGATGGGTACTTTTCTCTA | 74 | 621 |
| 780572 | N/A | N/A | 63219 | 63238 | AGGTAGAGAGAGAGTAACAC | 92 | 622 |
| 780573 | N/A | N/A | 63229 | 63248 | ATTTAGAGCTAGGTAGAGAG | 93 | 623 |
| 780574 | N/A | N/A | 63326 | 63345 | TGAGAAATAAAGTGCTATAG | 105 | 624 |
| 780575 | N/A | N/A | 63342 | 63361 | TGAATGGTAGTATATGTGAG | 84 | 625 |
| 780576 | N/A | N/A | 63662 | 63681 | ACATTGTGAGGTCAAAAAAG | 98 | 626 |
| 780577 | N/A | N/A | 64157 | 64176 | TCCCTCTCCAATGGGCCCAC | 74 | 627 |
| 780578 | N/A | N/A | 64433 | 64452 | TTCCAGAGTAATATGTTATG | 134 | 628 |
| 780579 | N/A | N/A | 64500 | 64519 | GATAAACCCCAAGAAGGCAA | 76 | 629 |
| 780580 | N/A | N/A | 64878 | 64897 | TACATTATGTATTAGCTCTA | 76 | 630 |
| 780581 | N/A | N/A | 65152 | 65171 | GTGTTCAAGTCATAGAAATG | 88 | 631 |
| 780582 | N/A | N/A | 65840 | 65859 | AACCAATTAGTATAACATTT | 75 | 632 |

TABLE 8

Percent control of human LRRK2 RNA with 5-10-5 MOE gapmers
with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693428 | 2361 | 2380 | 61982 | 62001 | GCTCTCTTTCTCACATACCT | 39 | 73 |
| 780254 | 4111 | 4130 | 86606 | 86625 | GTTTCATTCGGTTATAAGGC | 30 | 235 |
| 780583 | N/A | N/A | 66279 | 66298 | CTCATTTTTTGCCCTCTCAA | 55 | 633 |
| 780584 | N/A | N/A | 66413 | 66432 | TAATTTTCAAAGCGCATGAA | 66 | 634 |
| 780585 | N/A | N/A | 66417 | 66436 | ATGTTAATTTTCAAAGCGCA | 39 | 635 |
| 780586 | N/A | N/A | 66480 | 66499 | GAAGAAACTTTTTTGGATAA | 72 | 636 |
| 780587 | N/A | N/A | 68762 | 68781 | AATAAATTTGGCAACTTATA | 126 | 637 |

TABLE 8-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780588 | N/A | N/A | 68885 | 68904 | GAGAAAGTAACACAAACAAT | 106 | 638 |
| 780589 | N/A | N/A | 69914 | 69933 | CAAATCCTCAATTACAACTT | 91 | 639 |
| 780590 | N/A | N/A | 69919 | 69938 | ACCAACAAATCCTCAATTAC | 98 | 640 |
| 780591 | N/A | N/A | 70220 | 70239 | GGAGATAGAGATCAACATTT | 55 | 641 |
| 780592 | N/A | N/A | 70279 | 70298 | AATTAAGGGCCATATACATA | 79 | 642 |
| 780593 | N/A | N/A | 72795 | 72814 | ACCCAATTATGAGGATAAAA | 41 | 643 |
| 780594 | N/A | N/A | 72902 | 72921 | TCATTTATTGGAGAAGAGGA | 115 | 644 |
| 780595 | N/A | N/A | 73395 | 73414 | AAACCAAACTATGGAGTTTA | 89 | 645 |
| 780596 | N/A | N/A | 75173 | 75192 | AAGTCCTGTCCTCAAAGAGT | 74 | 646 |
| 780597 | N/A | N/A | 75176 | 75195 | AACAAGTCCTGTCCTCAAAG | 99 | 647 |
| 780598 | N/A | N/A | 75470 | 75489 | AACAAACAAAGTGCCATCTA | 52 | 648 |
| 780599 | N/A | N/A | 75646 | 75665 | ATTATAGAGGCTTATTAACC | 83 | 649 |
| 780600 | N/A | N/A | 76096 | 76115 | TAGAGTTGAAAGCTTCCTTC | 65 | 650 |
| 780601 | N/A | N/A | 76298 | 76317 | CCATCTGAGGAACTTAAGTC | 67 | 651 |
| 780602 | N/A | N/A | 76349 | 76368 | GTCAAACTCTTCAGAGTCTG | 24 | 652 |
| 780603 | N/A | N/A | 76970 76997 | 76989 77016 | TATATAGTATATATAATA | 138 | 653 |
| 780604 | N/A | N/A | 76973 77000 | 76992 77019 | TTATATATAGTATATATATA | 104 | 654 |
| 780605 | N/A | N/A | 76976 77003 | 76995 77022 | GTATTATATATAGTATATAT | 106 | 655 |
| 780606 | N/A | N/A | 76979 77006 | 76998 77025 | TAAGTATTATATATAGTATA | 105 | 656 |
| 780607 | N/A | N/A | 76982 77009 | 77001 77028 | TAATAAGTATTATATATAGT | 76 | 657 |
| 780608 | N/A | N/A | 76985 77012 | 77004 77031 | ATATAATAAGTATTATATAT | 78 | 658 |
| 780609 | N/A | N/A | 76988 77015 | 77007 77034 | TATATATAATAAGTATTATA | 126 | 659 |
| 780610 | N/A | N/A | 77524 | 77543 | TTTCATAGTTTTATAGCATT | 72 | 660 |
| 780611 | N/A | N/A | 77611 | 77630 | GTCTTATAGTTGGGAACGAA | 43 | 661 |
| 780612 | N/A | N/A | 78065 | 78084 | ACTATCATTTTAACCTCTGA | 71 | 662 |
| 780613 | N/A | N/A | 78080 | 78099 | ACAGTAGGCCAAGTAACTAT | 80 | 663 |
| 780614 | N/A | N/A | 78344 | 78363 | AAGTGATGATAATAATTTGC | 54 | 664 |
| 780615 | N/A | N/A | 78724 | 78743 | TGGCCAATATTCAGGAGGGT | 81 | 665 |
| 780616 | N/A | N/A | 78787 | 78806 | GCTTTGCTTACTAGTGAGTG | 70 | 666 |
| 780617 | N/A | N/A | 81581 87838 | 81600 87857 | GTTTGAAGGAATAGCTGACA | 60 | 667 |
| 780618 | N/A | N/A | 81584 87841 | 81603 87860 | AGTGTTTGAAGGAATAGCTG | 52 | 668 |

TABLE 8-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780619 | N/A | N/A | 81587 87844 | 81606 87863 | CATAGTGTTTGAAGGAATAG | 129 | 669 |
| 780620 | N/A | N/A | 81590 87847 | 81609 87866 | AGCCATAGTGTTTGAAGGAA | 40 | 670 |
| 780621 | N/A | N/A | 81593 87850 | 81612 87869 | AAAAGCCATAGTGTTTGAAG | 91 | 671 |
| 780622 | N/A | N/A | 81596 87853 | 81615 87872 | CTAAAAAGCCATAGTGTTTG | 85 | 672 |
| 780623 | N/A | N/A | 81599 87856 | 81618 87875 | ATTCTAAAAAGCCATAGTGT | 117 | 673 |
| 780624 | N/A | N/A | 81630 87887 | 81649 87906 | GCAGCATCATGCAAGCAGCA | 31 | 674 |
| 780625 | N/A | N/A | 81633 87890 | 81652 87909 | ATTGCAGCATCATGCAAGCA | 81 | 675 |
| 780626 | N/A | N/A | 83145 | 83164 | TGGCGGAATGCAGAAATTTA | 61 | 676 |
| 780627 | N/A | N/A | 83842 | 83861 | GTGGGAAGGAAGAAATGTGC | 70 | 677 |
| 780628 | N/A | N/A | 84184 | 84203 | AGCATATTAATGCCAAATAT | 73 | 678 |
| 780629 | N/A | N/A | 84201 | 84220 | AAAGGCAAATGACACACAGC | 87 | 679 |
| 780630 | N/A | N/A | 84266 | 84285 | ATTAGTCTGGCTAAGAAGAA | 95 | 680 |
| 780631 | N/A | N/A | 84723 | 84742 | ACAGAGCTGAGGTCTGCAAC | 58 | 681 |
| 780632 | N/A | N/A | 84951 | 84970 | AAGCTCAGGAGTTCAGAAAA | 111 | 682 |
| 780633 | N/A | N/A | 86880 | 86899 | GGTTTCTGGATATTAGAACA | 76 | 683 |
| 780634 | N/A | N/A | 87013 | 87032 | TTGTCAGCAACCGATCAAAG | 82 | 684 |
| 780635 | N/A | N/A | 88098 | 88117 | CAATTTGGAGTCTACAATGA | 78 | 685 |
| 780636 | N/A | N/A | 88353 | 88372 | AAATGTAACCTTACGACATT | 77 | 686 |
| 780637 | N/A | N/A | 88867 | 88886 | TAATGCTAACAGCAACAAGG | 85 | 687 |
| 780638 | N/A | N/A | 89084 | 89103 | TCACCTTTACCCTTGTGATT | 57 | 688 |
| 780639 | N/A | N/A | 89635 | 89654 | CAGGCCAAATAGGACTCTAT | 51 | 689 |
| 780640 | N/A | N/A | 89998 | 90017 | AGTCATATTAGTTTCTAATT | 96 | 690 |
| 780641 | N/A | N/A | 90808 | 90827 | CTGCTCTGCTAATGGGCTGG | 54 | 691 |
| 780642 | N/A | N/A | 91043 | 91062 | TTCATGTATCTCTTAACCCA | 42 | 692 |
| 780643 | N/A | N/A | 91084 | 91103 | ACTTCCATATTTACCTGCAA | 105 | 693 |
| 780644 | N/A | N/A | 92608 | 92627 | TGCACTAAACTCATTTGACA | 98 | 694 |
| 780645 | N/A | N/A | 92700 | 92719 | GCATCATCTCAGGGAGCCAT | 45 | 695 |
| 780646 | N/A | N/A | 92957 | 92976 | CAGCATATCTCAGCATACCT | 51 | 696 |
| 780647 | N/A | N/A | 93284 | 93303 | CAAACAGTGAAACATGGAAT | 89 | 697 |
| 780648 | N/A | N/A | 93697 | 93716 | TTCAATTGACTAATTCAGTA | 85 | 698 |
| 780649 | N/A | N/A | 94459 | 94478 | GCTGATTGCAATGTTTCAAT | 33 | 699 |
| 780650 | N/A | N/A | 94553 | 94572 | AAATCACATTATCCATGACA | 78 | 700 |

TABLE 8-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780651 | N/A | N/A | 95499 | 95518 | AATAGCTGTCAGACAAGTTG | 64 | 701 |
| 780652 | N/A | N/A | 95576 | 95595 | TTAGAGCTTCTGCACCATGA | 91 | 702 |
| 780653 | N/A | N/A | 95725 | 95744 | TTCCACCTGATTAATTGAAT | 70 | 703 |
| 780654 | N/A | N/A | 96460 | 96479 | ATTTTTTAAAGAGTTTGTGC | 51 | 704 |
| 780655 | N/A | N/A | 96720 | 96739 | TATAAACTCATAGGCCCTGG | 74 | 705 |
| 780656 | N/A | N/A | 97174 | 97193 | GTTTAAGGAATACTTAAACA | 81 | 706 |
| 780657 | N/A | N/A | 97323 | 97342 | TGCCCTGAGAATGAAATAAC | 73 | 707 |
| 780658 | N/A | N/A | 97591 | 97610 | TTTGATGGATTCTACTTGCA | 83 | 708 |
| 780659 | N/A | N/A | 97610 | 97629 | CTCAAAGTAACTACTGCATT | 46 | 709 |

TABLE 9

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693428 | 2361 | 2380 | 61982 | 62001 | GCTCTCTTTCTCACATACCT | 38 | 73 |
| 780254 | 4111 | 4130 | 86606 | 86625 | GTTTCATTCGGTTATAAGGC | 27 | 235 |
| 780660 | N/A | N/A | 99313 | 99332 | TCTAAAAATCTAATAAGTCT | 89 | 710 |
| 780661 | N/A | N/A | 99451 | 99470 | TACTCCAAGGTTTTATGAGC | 81 | 711 |
| 780662 | N/A | N/A | 99569 | 99588 | AAGAGATAATTACAGTCCCT | 71 | 712 |
| 780663 | N/A | N/A | 99813 | 99832 | CTAAACGCAAAACTTTCTGA | 107 | 713 |
| 780664 | N/A | N/A | 100778 | 100797 | TAGAATACAAGATTTTATTG | 134 | 714 |
| 780665 | N/A | N/A | 102009 | 102028 | TGAGCACCTAAACATGCTAC | 65 | 715 |
| 780666 | N/A | N/A | 102270 | 102289 | ACAGCATCGCAGGTCTTGTA | 50 | 716 |
| 780667 | N/A | N/A | 102579 | 102598 | AATGCATTTCATAGTTGTCC | 60 | 717 |
| 780668 | N/A | N/A | 104248 | 104267 | TTCTCTATTTGAGAATCGCC | 64 | 718 |
| 780669 | N/A | N/A | 104621 | 104640 | AAATTTCAAGTTGGAGTAGG | 85 | 719 |
| 780670 | N/A | N/A | 105660 | 105679 | GTCATATAGTGGCCCCTAAA | 31 | 720 |
| 780671 | N/A | N/A | 106100 | 106119 | CACTGGTATGCCCTTCCAAC | 65 | 721 |
| 780672 | N/A | N/A | 106561 | 106580 | GAATTTCTTACTTGTCTTAA | 95 | 722 |
| 780673 | N/A | N/A | 107953 | 107972 | GCTACATAAAATAAATCACC | 79 | 723 |
| 780674 | N/A | N/A | 109817 | 109836 | AGAGTCTGAAGTATCTAGAA | 98 | 724 |
| 780675 | N/A | N/A | 110040 | 110059 | TGAAGCCTGGAACCAGTTTA | 94 | 725 |
| 780676 | N/A | N/A | 110227 | 110246 | CCTAAAGCCAATTAGCACAA | 101 | 726 |
| 780677 | N/A | N/A | 110637 | 110656 | AGTGTAGCCACTAAGAATTT | 88 | 727 |

TABLE 9-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780678 | N/A | N/A | 110978 | 110997 | CTTATACACTAATTGGCTCT | 66 | 728 |
| 780679 | N/A | N/A | 111011 | 111030 | TTTCTTCCACCATTCCCTTA | 101 | 729 |
| 780680 | N/A | N/A | 111182 | 111201 | CTCACTAATTGCAAAGAAAA | 109 | 730 |
| 780681 | N/A | N/A | 111343 | 111362 | CAAAGCTTCAGACTGTGATC | 70 | 731 |
| 780682 | N/A | N/A | 111843 | 111862 | TCAGAGAGGCCCGCCATGGG | 122 | 732 |
| 780683 | N/A | N/A | 111897 | 111916 | TTCACATGGCTGAAGTCTTG | 115 | 733 |
| 780684 | N/A | N/A | 112310 | 112329 | ATCTACTGAATTCTGGTTAG | 103 | 734 |
| 780685 | N/A | N/A | 112349 | 112368 | GCACACAGTGTAGTCATACT | 44 | 735 |
| 780686 | N/A | N/A | 114870 | 114889 | AACCCAAGATTCCCCCTGGT | 99 | 736 |
| 780687 | N/A | N/A | 115427 | 115446 | TGGAGAAGTAAGCTAACAGT | 109 | 737 |
| 780688 | N/A | N/A | 115958 | 115977 | TAACTGAAAATTCAAGCCTG | 115 | 738 |
| 780689 | N/A | N/A | 116039 | 116058 | CTTAAGGAAATGAGCTCTC | 106 | 739 |
| 780690 | N/A | N/A | 116174 | 116193 | TATAATATCTAGCTTTCCCT | 95 | 740 |
| 780691 | N/A | N/A | 116253 | 116272 | CAGAGGGAGAAAAACACTGA | 110 | 741 |
| 780692 | N/A | N/A | 116357 | 116376 | CCCTTGAGGGTGTCACAATC | 82 | 742 |
| 780693 | N/A | N/A | 116374 | 116393 | ATCTTTGTATCTCTGCTCCC | 89 | 743 |
| 780694 | N/A | N/A | 116669 | 116688 | TTGAAATAATAAGTAAAGAT | 123 | 744 |
| 780695 | N/A | N/A | 116874 | 116893 | ATAAGACATGCCTCTTTAAG | 74 | 745 |
| 780696 | N/A | N/A | 117178 | 117197 | AGTACATATTATTTAACTGC | 61 | 746 |
| 780697 | N/A | N/A | 117306 | 117325 | ACTGTTGGTTTTGGCTCACA | 66 | 747 |
| 780698 | N/A | N/A | 117646 | 117665 | TCTGGAGACTGACCCACGCA | 73 | 748 |
| 780699 | N/A | N/A | 118398 | 118417 | GCTGAGTGGAGGTATCTGCC | 92 | 749 |
| 780700 | N/A | N/A | 119907 | 119926 | ATATGGTTTAGGAGAGACTA | 41 | 750 |
| 780701 | N/A | N/A | 121039 | 121058 | ATACTTAACTCATGGATAGA | 80 | 751 |
| 780702 | N/A | N/A | 121425 | 121444 | AAAAGTGCAATTGCCATAGG | 57 | 752 |
| 780703 | N/A | N/A | 121530 | 121549 | CCGGTAACATTTTATTTACC | 62 | 753 |
| 780704 | N/A | N/A | 121871 | 121890 | TCAATGTATTGTTGCCAAAT | 45 | 754 |
| 780705 | N/A | N/A | 122553 | 122572 | ATGAGCTACCCACACAGTCA | 78 | 755 |
| 780706 | N/A | N/A | 123081 | 123100 | TTGGAAGGATGGAGACATCG | 28 | 756 |
| 780707 | N/A | N/A | 123885 | 123904 | TGATATGGCATGATGTCTAC | 67 | 757 |
| 780708 | N/A | N/A | 124062 | 124081 | AGATGATATGCTATGACATA | 77 | 758 |
| 780709 | N/A | N/A | 124679 | 124698 | TGTCCTGTCTCATAACATCT | 68 | 759 |
| 780710 | N/A | N/A | 125144 | 125163 | AGAATATTTATGCACTAAAC | 71 | 760 |
| 780711 | N/A | N/A | 125277 | 125296 | GTTCTAACAGCAATTTCCTT | 78 | 761 |
| 780712 | N/A | N/A | 126145 | 126164 | ATCCTTATGTCCTCACAGAT | 89 | 762 |

TABLE 9-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780713 | N/A | N/A | 126446 | 126465 | TATTTCCTCTCAATGTTTAT | 125 | 763 |
| 780714 | N/A | N/A | 127216 | 127235 | TTAAAAAAAGGAATGGGATA | 92 | 764 |
| 780715 | N/A | N/A | 127242 | 127261 | CAACCTGAAAAAATTAGTCT | 79 | 765 |
| 780716 | N/A | N/A | 127360 | 127379 | ATAAATGAGTTGATCAGTGG | 83 | 766 |
| 780717 | N/A | N/A | 127443 | 127462 | TATTCCTGGATGAGAAAAT | 103 | 767 |
| 780718 | N/A | N/A | 127460 | 127479 | CCTAAGACTGGTTAAAATAT | 91 | 768 |
| 780719 | N/A | N/A | 128188 | 128207 | ATAAGGAAAGTTGTTCTGGG | 108 | 769 |
| 780720 | N/A | N/A | 132660 | 132679 | ATGCAATAACAATTATGCAC | 75 | 770 |
| 780721 | N/A | N/A | 133278 | 133297 | GGAGTTGATATTTCAGGTAC | 81 | 771 |
| 780722 | N/A | N/A | 134443 | 134462 | TTTTCAGAGGATCTACTGTG | 90 | 772 |
| 780723 | N/A | N/A | 136265 | 136284 | TAAATGTGAGGAAATATTTG | 94 | 773 |
| 780724 | N/A | N/A | 137896 | 137915 | CATATGTATAGTCCGTGAAT | 81 | 774 |
| 780725 | N/A | N/A | 138142 | 138161 | TCACTGAGGAATGTGATAAA | 108 | 775 |
| 780726 | N/A | N/A | 138369 | 138388 | TTTATTGACAGCTTACCAGG | 83 | 776 |
| 780727 | N/A | N/A | 138502 | 138521 | AGCAAAAAACAAAGGAGTCA | 94 | 777 |
| 780728 | N/A | N/A | 138562 | 138581 | GAGAACAGTGAGAAGTACAA | 100 | 778 |
| 780729 | N/A | N/A | 138891 | 138910 | TAGAGATCTGAGTCAATTTC | 70 | 779 |
| 780730 | N/A | N/A | 139058 | 139077 | GCTACTGTGAAGGAAAACAT | 66 | 780 |
| 780731 | N/A | N/A | 139370 | 139389 | ATCCAAATGTTAACCACATA | 60 | 781 |
| 780732 | N/A | N/A | 139871 | 139890 | ACAGGAGATACTTGTTCAGA | 62 | 782 |
| 780733 | N/A | N/A | 140263 | 140282 | TAGAAAATAGTTCCAATTAG | 86 | 783 |
| 780734 | N/A | N/A | 140887 | 140906 | CCTTAAAATATTTCCCTTTC | 115 | 784 |
| 780735 | N/A | N/A | 141689 | 141708 | AAAGATAATTCTTTTGGGAA | 129 | 785 |
| 780736 | N/A | N/A | 144735 144754 | 144754 144773 | GTACAAATATGAGTATTTAG | 65 | 786 |

Example 4: Effect of 5-10-5 MOE Gapmers with Mixed Internucleoside Linkages on Human LRRK2 RNA Expression In Vitro, Single Dose Modified oligonucleotides complementary to a human LRRK2 nucleic acid were designed and tested for their effect on LRRK2 RNA in vitro. The modified oligonucleotides were tested in a series of experiments that had similar culture conditions.

Cultured SH-SY5Y cells at a density of 20,000 cells per well were transfected using electroporation with 4,000 nM concentration of modified oligonucleotide or no modified oligonucleotide for untreated controls. After approximately 24 hours, RNA was isolated from the cells and LRRK2 RNA levels were measured by quantitative real-time PCR using human primer probe set RTS3132 as described in Example 2. LRRK2 RNA levels were adjusted according to total RNA content, as measured by RIBOGREEN®. Results are presented in the table below as percent LRRK2 RNA levels relative to untreated control cells. The modified oligonucleotides with percent control values marked with an asterisk (*) target the amplicon region of the primer probe set. Additional assays may be used to measure the potency and efficacy of oligonucleotides targeting the amplicon region.

The modified oligonucleotides in Tables 10-50 are 5-10-5 MOE gapmers. The gapmers are 20 nucleobases in length, wherein the central gap segment comprises ten 2'-deoxynucleosides and is flanked by wing segments on both the 5' end and on the 3' end comprising five 2'-MOE nucleosides. The sugar motif for the gapmers is (from 5' to 3'): eeeeedddddddddddeeeee; wherein 'd' represents a 2'-deoxyribose sugar and 'e' represents a 2'-MOE modified sugar. All cytosine residues throughout each gapmer are 5-methyl cytosines. The internucleoside linkages for each gapmer are mixed phosphodiester and phosphorothioate linkages. The internucleoside linkage motif for the gapmers is (from 5' to 3'): sooosssssssssssooss; wherein 'o' represents a phosphodiester internucleoside linkage and 's' represents a phosphorothioate internucleoside linkage. "Start Site" indicates the 5'-most nucleoside to which the gapmer is complementary in the human nucleic acid sequence. "Stop Site" indicates the 3'-most nucleoside to which the gapmer is complementary in the human nucleic acid sequence.

Each modified oligonucleotide listed in Tables 10-50 below is complementary to human LRRK2 nucleic acid sequences SEQ ID NO: 1 or SEQ ID NO: 2, as indicated. 'N/A' indicates that the modified oligonucleotide is not complementary to that particular nucleic acid sequence with 100% complementarity. As shown below, modified oligonucleotides complementary to the sequence of human LRRK2 RNA reduced the amount of human LRRK2 RNA.

TABLE 10

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693426 | 185 | 204 | 3304 | 3323 | TCCTGGACATTGTTCAGCCT | 39 | 55 |
| 780254 | 4111 | 4130 | 86606 | 86625 | GTTTCATTCGGTTATAAGGC | 19 | 235 |
| 780254 | 4111 | 4130 | 86606 | 86625 | GTTTCATTCGGTTATAAGGC | 37 | 235 |
| 802613 | 10 | 29 | 3129 | 3148 | GAGCTCAGCTCACCGCCCGC | 99 | 787 |
| 802614 | 33 | 52 | 3152 | 3171 | GCCGGCCACAGCTCCCCGGG | 138 | 788 |
| 802615 | 80 | 99 | 3199 | 3218 | CCGCCCTCCCAGCATGAACG | 89 | 789 |
| 802616 | 89 | 108 | 3208 | 3227 | TCCAACCCGCCGCCCTCCCA | 122 | 790 |
| 802617 | 109 | 128 | 3228 | 3247 | TAGCCATGGTGGCACCTGCT | 68 | 791 |
| 802618 | 118 | 137 | 3237 | 3256 | AGCTGCCACTAGCCATGGTG | 126 | 792 |
| 802619 | 127 | 146 | 3246 | 3265 | ACCCCTGACAGCTGCCACTA | 83 | 793 |
| 802620 | 136 | 155 | 3255 | 3274 | CCTCTTCGCACCCCTGACAG | 106 | 794 |
| 802621 | 198 | 217 | 3317 | 3336 | TATCTGTTTTCCTTCCTGGA | 67 | 795 |
| 802622 | 199 | 218 | 3318 | 3337 | CTATCTGTTTTCCTTCCTGG | 46 | 796 |
| 802623 | 200 | 219 | 3319 | 3338 | TCTATCTGTTTTCCTTCCTG | 50 | 797 |
| 802624 | 201 | 220 | 3320 | 3339 | TTCTATCTGTTTTCCTTCCT | 42 | 798 |
| 802625 | 202 | 221 | 3321 | 3340 | TTTCTATCTGTTTTCCTTCC | 69 | 799 |
| 802626 | 204 | 223 | 3323 | 3342 | CGTTTCTATCTGTTTTCCTT | 46 | 800 |
| 802627 | 222 | 241 | 3341 | 3360 | CTCCAGGATTTGGACCAGCG | 45 | 801 |
| 802628 | 231 | 250 | 3350 | 3369 | CAGCAGATCCTCCAGGATTT | 91 | 802 |
| 802629 | 240 | 259 | 3359 | 3378 | CGTGAACACCAGCAGATCCT | 68 | 803 |
| 802630 | 280 | 299 | 3671 | 3690 | TATTTTTGCCTTGAAATAAC | 104 | 804 |
| 802631 | 289 | 308 | 3680 | 3699 | GCACATGGATATTTTTGCCT | 38 | 805 |
| 802632 | 298 | 317 | 3689 | 3708 | TCAACAGAGGCACATGGATA | 60 | 806 |
| 802633 | 324 | 343 | 3715 | 3734 | GACTCTCATATAGGAGTCCA | 124 | 807 |
| 802634 | 333 | 352 | 3724 | 3743 | CACACTCGCGACTCTCATAT | 109 | 808 |
| 802635 | 342 | 361 | N/A | N/A | CACCTGCTGCACACTCGCGA | 58 | 809 |
| 802636 | 351 | 370 | N/A | N/A | TGACCAACCCACCTGCTGCA | 101 | 810 |
| 802637 | 371 | 390 | 10395 | 10414 | TCTATTAATTTGCACAGAAG | 104 | 811 |
| 802638 | 380 | 399 | 10404 | 10423 | GGACAGACTTCTATTAATTT | 61 | 812 |
| 802639 | 389 | 408 | 10413 | 10432 | ATTGTACCTGGACAGACTTC | 53 | 813 |

TABLE 10-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802640 | 426 | 445 | 10450 | 10469 | ATCATTTCCAACATCCTGGG | 82 | 814 |
| 802641 | 435 | 454 | 10459 | 10478 | GACTTCCCAATCATTTCCAA | 98 | 815 |
| 802642 | 460 | 479 | N/A | N/A | TAAGAATCAATTGGTGAACA | 62 | 816 |
| 802643 | 469 | 488 | 13735 | 13754 | TTAGCATTTTAAGAATCAAT | 49 | 817 |
| 802644 | 480 | 499 | 13746 | 13765 | ATTATGAACTGTTAGCATTT | 47 | 818 |
| 802645 | 504 | 523 | 13770 | 13789 | AATCACTGACAAGTTTACAC | 74 | 819 |
| 802646 | 513 | 532 | 13779 | 13798 | CTTCAGTCCAATCACTGACA | 54 | 820 |
| 802647 | 522 | 541 | 13788 | 13807 | ATCTAAGGTCTTCAGTCCAA | 80 | 821 |
| 802648 | 534 | 553 | 13800 | 13819 | AGTTAGGAGGAGATCTAAGG | 106 | 822 |
| 802649 | 535 | 554 | 13801 | 13820 | AAGTTAGGAGGAGATCTAAG | 96 | 823 |
| 802650 | 536 | 555 | 13802 | 13821 | GAAGTTAGGAGGAGATCTAA | 87 | 824 |
| 802651 | 537 | 556 | 13803 | 13822 | TGAAGTTAGGAGGAGATCTA | 94 | 825 |
| 802652 | 538 | 557 | 13804 | 13823 | CTGAAGTTAGGAGGAGATCT | 58 | 826 |
| 802653 | 540 | 559 | 13806 | 13825 | ACCTGAAGTTAGGAGGAGAT | 41 | 827 |
| 802654 | 541 | 560 | 13807 | 13826 | TACCTGAAGTTAGGAGGAGA | 53 | 828 |
| 802655 | 542 | 561 | 13808 | 13827 | TTACCTGAAGTTAGGAGGAG | 33 | 829 |
| 802656 | 543 | 562 | N/A | N/A | TTTACCTGAAGTTAGGAGGA | 55 | 830 |
| 802657 | 544 | 563 | N/A | N/A | TTTTACCTGAAGTTAGGAGG | 56 | 831 |
| 802658 | 548 | 567 | N/A | N/A | GTGATTTTACCTGAAGTTAG | 53 | 832 |
| 802659 | 557 | 576 | 16077 | 16096 | ATCAGCAAGGTGATTTTACC | 61 | 833 |
| 802660 | 566 | 585 | 16086 | 16105 | TCATCCAATATCAGCAAGGT | 78 | 834 |
| 802661 | 575 | 594 | 16095 | 16114 | TCACTTTCTTCATCCAATAT | 53 | 835 |
| 802662 | 602 | 621 | 16122 | 16141 | ATGGCATCAAAAATTAACAT | 47 | 836 |
| 802663 | 603 | 622 | 16123 | 16142 | CATGGCATCAAAAATTAACA | 40 | 837 |
| 802664 | 605 | 624 | 16125 | 16144 | TGCATGGCATCAAAAATTAA | 75 | 838 |
| 802665 | 607 | 626 | 16127 | 16146 | AGTGCATGGCATCAAAAATT | 56 | 839 |
| 802666 | 609 | 628 | 16129 | 16148 | TGAGTGCATGGCATCAAAAA | 68 | 840 |
| 802667 | 610 | 629 | 16130 | 16149 | ATGAGTGCATGGCATCAAAA | 62 | 841 |
| 802668 | 612 | 631 | 16132 | 16151 | AAATGAGTGCATGGCATCAA | 54 | 842 |
| 802669 | 613 | 632 | 16133 | 16152 | GAAATGAGTGCATGGCATCA | 49 | 843 |
| 802670 | 620 | 639 | 16140 | 16159 | TTGGCTGGAAATGAGTGCAT | 42 | 844 |
| 802671 | 638 | 657 | 16158 | 16177 | AGTTTCTGGACTTCATCATT | 95 | 845 |
| 802672 | 647 | 666 | 16167 | 16186 | TTGCATCCAAGTTTCTGGAC | 70 | 846 |
| 802673 | 656 | 675 | 16176 | 16195 | TGTAAAGCTTTGCATCCAAG | 73 | 847 |
| 802674 | 682 | 701 | N/A | N/A | CCTCTGAGACTCTCTCAAAC | 41 | 848 |

TABLE 10-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802675 | 691 | 710 | 18590 | 18609 | TCAGTTGCTCCTCTGAGACT | 51 | 849 |
| 802676 | 700 | 719 | 18599 | 18618 | CAAATTCAGTCAGTTGCTCC | 69 | 850 |
| 802677 | 726 | 745 | 18625 | 18644 | CAATATCATATAATCTTTGT | 101 | 851 |
| 802678 | 735 | 754 | 18634 | 18653 | CGCACTTAACAATATCATAT | 34 | 852 |
| 802679 | 744 | 763 | 18643 | 18662 | ATTTGTTAACGCACTTAACA | 63 | 853 |
| 802680 | 753 | 772 | 18652 | 18671 | ATCTTTAAAATTTGTTAACG | 136 | 854 |
| 802681 | 773 | 792 | 18672 | 18691 | TGAAGCACAATTTCCTCTTC | 51 | 855 |
| 802682 | 782 | 801 | 18681 | 18700 | TGCAGCACATGAAGCACAAT | 67 | 856 |
| 802683 | 791 | 810 | 18690 | 18709 | TGTAAACAATGCAGCACATG | 77 | 857 |
| 802684 | 817 | 836 | N/A | N/A | CATTATTGCAAGGAATCGCT | 58 | 858 |
| 802685 | 826 | 845 | N/A | N/A | GGACTTCCACATTATTGCAA | 32 | 859 |
| 802686 | 835 | 854 | 21666 | 21685 | CACTCATGAGGACTTCCACA | 34 | 860 |
| 802687 | 861 | 880 | 21692 | 21711 | CACAATATTATAACACCTGA | 50 | 861 |
| 802688 | 879 | 898 | 21710 | 21729 | TGCTTTCATAGCTTCCACCA | 32 | 862 |

TABLE 11

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 42 | 235 |
| 780254 | 4111 | 4130 | 86606 | 86625 | GTTTCATTCGGTTATAAGGC | 17 | 235 |
| 802689 | 880 | 899 | 21711 | 21730 | ATGCTTTCATAGCTTCCACC | 24 | 863 |
| 802690 | 882 | 901 | 21713 | 21732 | GAATGCTTTCATAGCTTCCA | 36 | 864 |
| 802691 | 884 | 903 | 21715 | 21734 | GGGAATGCTTTCATAGCTTC | 30 | 865 |
| 802692 | 886 | 905 | 21717 | 21736 | TAGGGAATGCTTTCATAGCT | 36 | 866 |
| 802693 | 887 | 906 | 21718 | 21737 | ATAGGGAATGCTTTCATAGC | 44 | 867 |
| 802694 | 889 | 908 | 21720 | 21739 | TCATAGGGAATGCTTTCATA | 53 | 868 |
| 802695 | 890 | 909 | 21721 | 21740 | CTCATAGGGAATGCTTTCAT | 44 | 869 |
| 802696 | 891 | 910 | 21722 | 21741 | ACTCATAGGGAATGCTTTCA | 25 | 870 |
| 802697 | 892 | 911 | 21723 | 21742 | CACTCATAGGGAATGCTTTC | 48 | 871 |
| 802698 | 893 | 912 | 21724 | 21743 | TCACTCATAGGGAATGCTTT | 29 | 872 |
| 802699 | 894 | 913 | 21725 | 21744 | TTCACTCATAGGGAATGCTT | 41 | 873 |
| 802700 | 895 | 914 | 21726 | 21745 | TTTCACTCATAGGGAATGCT | 19 | 874 |
| 802701 | 897 | 916 | 21728 | 21747 | TCTTTCACTCATAGGGAATG | 27 | 875 |

TABLE 11-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
| --- | --- | --- | --- | --- | --- | --- | --- |
| 802702 | 898 | 917 | 21729 | 21748 | TTCTTTCACTCATAGGGAAT | 40 | 876 |
| 802703 | 899 | 918 | 21730 | 21749 | ATTCTTTCACTCATAGGGAA | 35 | 877 |
| 802704 | 900 | 919 | 21731 | 21750 | AATTCTTTCACTCATAGGGA | 40 | 878 |
| 802705 | 901 | 920 | 21732 | 21751 | GAATTCTTTCACTCATAGGG | 30 | 879 |
| 802706 | 905 | 924 | 21736 | 21755 | TCTTGAATTCTTTCACTCAT | 43 | 880 |
| 802707 | 915 | 934 | 21746 | 21765 | GCAACTCACTTCTTGAATTC | 53 | 881 |
| 802708 | 924 | 943 | 21755 | 21774 | GAGCAAACAGCAACTCACTT | 71 | 882 |
| 802709 | 949 | 968 | N/A | N/A | AAAAATTACCTAATGTAAGC | 112 | 883 |
| 802710 | 958 | 977 | 27933 | 27952 | GGATATTGAAAAAATTACCT | 55 | 884 |
| 802711 | 967 | 986 | 27942 | 27961 | TTAATACCAGGATATTGAAA | 88 | 885 |
| 802712 | 989 | 1008 | 27964 | 27983 | ACCACAAACTCATGGACTTC | 42 | 886 |
| 802713 | 990 | 1009 | 27965 | 27984 | CACCACAAACTCATGGACTT | 34 | 887 |
| 802714 | 991 | 1010 | 27966 | 27985 | TCACCACAAACTCATGGACT | 45 | 888 |
| 802715 | 992 | 1011 | 27967 | 27986 | TTCACCACAAACTCATGGAC | 61 | 889 |
| 802716 | 993 | 1012 | 27968 | 27987 | TTTCACCACAAACTCATGGA | 45 | 890 |
| 802717 | 998 | 1017 | 27973 | 27992 | ACAGCTTTCACCACAAACTC | 35 | 891 |
| 802718 | 1007 | 1026 | 27982 | 28001 | TACTGCTGCACAGCTTTCAC | 40 | 892 |
| 802719 | 1016 | 1035 | 27991 | 28010 | TTCTCTGGGTACTGCTGCAC | 47 | 893 |
| 802720 | 1055 | 1074 | 28030 | 28049 | AGGGCCAAACAGCTGAGCGC | 70 | 894 |
| 802721 | 1064 | 1083 | N/A | N/A | TCAGTGAGGAGGGCCAAACA | 83 | 895 |
| 802722 | 1090 | 1109 | 29351 | 29370 | CTAAATCTTGATTTAAGAAA | 134 | 896 |
| 802723 | 1099 | 1118 | 29360 | 29379 | TCTTTTCCTCTAAATCTTGA | 55 | 897 |
| 802724 | 1111 | 1130 | 29372 | 29391 | CTTGATTCTCATTCTTTTCC | 47 | 898 |
| 802725 | 1132 | 1151 | 29393 | 29412 | CTTCCCCCTCATCATCATTC | 58 | 899 |
| 802726 | 1141 | 1160 | 29402 | 29421 | ATTTATCTTCTTCCCCCTCA | 43 | 900 |
| 802727 | 1150 | 1169 | 29411 | 29430 | GCCAAAACAATTTATCTTCT | 44 | 901 |
| 802728 | 1176 | 1195 | 29437 | 29456 | CGTTAATGCTTTGTAACAGG | 26 | 902 |
| 802729 | 1194 | 1213 | 29455 | 29474 | CTTGTTCTTTCTATGCCACG | 64 | 903 |
| 802730 | 1225 | 1244 | 29576 | 29595 | TTAGTGCCCAGCATGCGGCC | 37 | 904 |
| 802731 | 1234 | 1253 | 29585 | 29604 | GGAGATTATTTAGTGCCCAG | 20 | 905 |
| 802732 | 1243 | 1262 | 29594 | 29613 | GGTACATAAGGAGATTATTT | 30 | 906 |
| 802733 | 1269 | 1288 | 29620 | 29639 | TCCAATCTTCTCATGTAAAC | 99 | 907 |
| 802734 | 1278 | 1297 | 29629 | 29648 | ATCTTCATCTCCAATCTTCT | 93 | 908 |
| 802735 | 1287 | 1306 | N/A | N/A | GAAATGGCCATCTTCATCTC | 110 | 909 |
| 802736 | 1313 | 1332 | 31029 | 31048 | GAGAGCATCACTTCCCTATG | 47 | 910 |

TABLE 11-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802737 | 1322 | 1341 | 31038 | 31057 | ATCAGCATGGAGAGCATCAC | 48 | 911 |
| 802738 | 1331 | 1350 | 31047 | 31066 | GAAGAATGCATCAGCATGGA | 58 | 912 |
| 802739 | 1357 | 1376 | 31073 | 31092 | CAGATGCCTGGAAAACTTCC | 51 | 913 |
| 802740 | 1366 | 1385 | 31082 | 31101 | ATGCATTCGCAGATGCCTGG | 43 | 914 |
| 802741 | 1375 | 1394 | 31091 | 31110 | GAGTTGACAATGCATTCGCA | 59 | 915 |
| 802742 | 1385 | 1404 | 31101 | 31120 | TGTTCTAAGAGAGTTGACAA | 85 | 916 |
| 802743 | 1426 | 1445 | 35373 | 35392 | GTATTCCTTTTGATAACAGT | 24 | 917 |
| 802744 | 1435 | 1454 | 35382 | 35401 | CATTCAGGTGTATTCCTTTT | 27 | 918 |
| 802745 | 1444 | 1463 | 35391 | 35410 | ACTCCAAAACATTCAGGTGT | 40 | 919 |
| 802746 | 1470 | 1489 | 35417 | 35436 | AGGAGAATGTATATGCTTCT | 18 | 920 |
| 802747 | 1479 | 1498 | 35426 | 35445 | AGCCACTTCAGGAGAATGTA | 27 | 921 |
| 802748 | 1488 | 1507 | 35435 | 35454 | GCCACTTTCAGCCACTTCAG | 21 | 922 |
| 802749 | 1514 | 1533 | 35461 | 35480 | TCAAAAGATGATTTAGCAT | 113 | 923 |
| 802750 | 1523 | 1542 | N/A | N/A | TTGCTTCCTTCAAAAGATG | 78 | 924 |
| 802751 | 1533 | 1552 | N/A | N/A | CAGGGAAGTGTTGCTTCCTT | 53 | 925 |
| 802752 | 1574 | 1593 | 37623 | 37642 | ATAACTGTTAGTATTTTGGG | 34 | 926 |
| 802753 | 1607 | 1626 | 37656 | 37675 | AGCTGCACTGGTAATGATGT | 57 | 927 |
| 802754 | 1631 | 1650 | 37680 | 37699 | TGTAAAATAGCTCGAAGCGC | 90 | 928 |
| 802755 | 1654 | 1673 | N/A | N/A | CTGGCATGCCAGGCACTATA | 62 | 929 |
| 802756 | 1663 | 1682 | N/A | N/A | TGGATTCTTCTGGCATGCCA | 40 | 930 |
| 802757 | 1672 | 1691 | 41905 | 41924 | TATCCTCCCTGGATTCTTCT | 69 | 931 |
| 802758 | 1699 | 1718 | 41932 | 41951 | CCATATTTAGCTTATGATGA | 20 | 932 |
| 802759 | 1708 | 1727 | 41941 | 41960 | GTTTTTTAACCATATTTAGC | 38 | 933 |
| 802760 | 1717 | 1736 | 41950 | 41969 | TGAAACACTGTTTTTTAACC | 48 | 934 |
| 802761 | 1743 | 1762 | 41976 | 41995 | TAGGACCAGTTTGTGAATAT | 72 | 935 |
| 802762 | 1752 | 1771 | 41985 | 42004 | CAAAGCTGCTAGGACCAGTT | 69 | 936 |
| 802763 | 1761 | 1780 | N/A | N/A | GAACCTGTTCAAAGCTGCTA | 47 | 937 |
| 802764 | 1770 | 1789 | N/A | N/A | ATTTCCAATGAACCTGTTCA | 71 | 938 |
| 802765 | 1784 | 1803 | 52698 | 52717 | TTCTGAATCCCAGGATTTCC | 38 | 939 |

TABLE 12

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 42 | 235 |
| 780254 | 4111 | 4130 | 86606 | 86625 | GTTTCATTCGGTTATAAGGC | 50 | 235 |
| 802766 | 1785 | 1804 | 52699 | 52718 | TTTCTGAATCCCAGGATTTC | 140 | 940 |
| 802767 | 1787 | 1806 | 52701 | 52720 | CATTTCTGAATCCCAGGATT | 97 | 941 |
| 802768 | 1788 | 1807 | 52702 | 52721 | ACATTTCTGAATCCCAGGAT | 60 | 942 |
| 802769 | 1790 | 1809 | 52704 | 52723 | CCACATTTCTGAATCCCAGG | 41 | 943 |
| 802770 | 1792 | 1811 | 52706 | 52725 | ATCCACATTTCTGAATCCCA | 57 | 944 |
| 802771 | 1794 | 1813 | 52708 | 52727 | TAATCCACATTTCTGAATCC | 119 | 945 |
| 802772 | 1806 | 1825 | 52720 | 52739 | AGAAATTACTTTTAATCCAC | 97 | 946 |
| 802773 | 1815 | 1834 | 52729 | 52748 | TACAATAGAAGAAATTACTT | 176 | 947 |
| 802774 | 1835 | 1854 | 52749 | 52768 | TCTAATGCATCAGGAAAATG | 145 | 948 |
| 802775 | 1844 | 1863 | 52758 | 52777 | GATAACATCTCTAATGCATC | 56 | 949 |
| 802776 | 1853 | 1872 | 52767 | 52786 | CCTTCCAGGGATAACATCTC | 125 | 950 |
| 802777 | 1862 | 1881 | 52776 | 52795 | TCCATAGCACCTTCCAGGGA | 73 | 951 |
| 802778 | 1868 | 1887 | 52782 | 52801 | ACTGAATCCATAGCACCTTC | 52 | 952 |
| 802779 | 1869 | 1888 | 52783 | 52802 | CACTGAATCCATAGCACCTT | 63 | 953 |
| 802780 | 1870 | 1889 | 52784 | 52803 | GCACTGAATCCATAGCACCT | 44 | 954 |
| 802781 | 1871 | 1890 | 52785 | 52804 | AGCACTGAATCCATAGCACC | 65 | 955 |
| 802782 | 1872 | 1891 | 52786 | 52805 | AAGCACTGAATCCATAGCAC | 70 | 956 |
| 802783 | 1874 | 1893 | 52788 | 52807 | TGAAGCACTGAATCCATAGC | 100 | 957 |
| 802784 | 1875 | 1894 | 52789 | 52808 | GTGAAGCACTGAATCCATAG | 53 | 958 |
| 802785 | 1876 | 1895 | 52790 | 52809 | TGTGAAGCACTGAATCCATA | 107 | 959 |
| 802786 | 1877 | 1896 | 52791 | 52810 | GTGTGAAGCACTGAATCCAT | 62 | 960 |
| 802787 | 1878 | 1897 | 52792 | 52811 | TGTGTGAAGCACTGAATCCA | 73 | 961 |
| 802788 | 1882 | 1901 | 52796 | 52815 | GCAGTGTGTGAAGCACTGAA | 100 | 962 |
| 802789 | 1891 | 1910 | 52805 | 52824 | GATACATCTGCAGTGTGTGA | 116 | 963 |
| 802790 | 1900 | 1919 | 52814 | 52833 | GGTCATCTGGATACATCTGC | 77 | 964 |
| 802791 | 1909 | 1928 | N/A | N/A | GAATTCTTGGTCATCTGGA | 106 | 965 |
| 802792 | 1928 | 1947 | 52968 | 52987 | AGACTTAAACCCAGACACTG | 78 | 966 |
| 802793 | 1937 | 1956 | 52977 | 52996 | TATCCTATAAGACTTAAACC | 157 | 967 |
| 802794 | 1946 | 1965 | 52986 | 53005 | GTAATCAAGTATCCTATAAG | 105 | 968 |
| 802795 | 1972 | 1991 | 53012 | 53031 | CAGTTCCTATGAACACATTC | 76 | 969 |
| 802796 | 1981 | 2000 | 53021 | 53040 | GCAGATGTCCAGTTCCTATG | 79 | 970 |
| 802797 | 1990 | 2009 | 53030 | 53049 | TTTTTGCCAGCAGATGTCCA | 117 | 971 |
| 802798 | 1999 | 2018 | 53039 | 53058 | AAACCAGAATTTTTGCCAGC | 81 | 972 |
| 802799 | 2018 | 2037 | 53058 | 53077 | TTAAATCGGTATAAGCTGGA | 112 | 973 |

TABLE 12-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802800 | 2027 | 2046 | 53067 | 53086 | GCAACATCCTTAAATCGGTA | 78 | 974 |
| 802801 | 2036 | 2055 | 53076 | 53095 | TGTATTTCAGCAACATCCTT | 145 | 975 |
| 802802 | 2062 | 2081 | N/A | N/A | CTAAGATTGTCTGAAATCCT | 84 | 976 |
| 802803 | 2071 | 2090 | 56005 | 56024 | TGAGGATTGCTAAGATTGTC | 84 | 977 |
| 802804 | 2080 | 2099 | 56014 | 56033 | CTGACAATTTGAGGATTGCT | 58 | 978 |
| 802805 | 2106 | 2125 | 56040 | 56059 | ATGCACCAGCAGCTTAGAAA | 71 | 979 |
| 802806 | 2115 | 2134 | 56049 | 56068 | AAATGATGATGCACCAGCA | 82 | 980 |
| 802807 | 2124 | 2143 | 56058 | 56077 | TACTAAGTCAAATGAATGAT | 109 | 981 |
| 802808 | 2151 | 2170 | 56085 | 56104 | GATATTGGAAGACATTTGAT | 143 | 982 |
| 802809 | 2160 | 2179 | 56094 | 56113 | TTGTTCCATGATATTGGAAG | 128 | 983 |
| 802810 | 2180 | 2199 | N/A | N/A | TTTAGAAACTGTTGATCCTT | 113 | 984 |
| 802811 | 2181 | 2200 | N/A | N/A | GTTTAGAAACTGTTGATCCT | 128 | 985 |
| 802812 | 2182 | 2201 | N/A | N/A | GGTTTAGAAACTGTTGATCC | 93 | 986 |
| 802813 | 2183 | 2202 | N/A | N/A | AGGTTTAGAAACTGTTGATC | 115 | 987 |
| 802814 | 2184 | 2203 | N/A | N/A | GAGGTTTAGAAACTGTTGAT | 118 | 988 |
| 802815 | 2186 | 2205 | N/A | N/A | CAGAGGTTTAGAAACTGTTG | 63 | 989 |
| 802816 | 2187 | 2206 | N/A | N/A | ACAGAGGTTTAGAAACTGTT | 84 | 990 |
| 802817 | 2188 | 2207 | N/A | N/A | AACAGAGGTTTAGAAACTGT | 119 | 991 |
| 802818 | 2189 | 2208 | N/A | N/A | CAACAGAGGTTTAGAAACTG | 99 | 992 |
| 802819 | 2190 | 2209 | 56198 | 56217 | GCAACAGAGGTTTAGAAACT | 94 | 993 |
| 802820 | 2194 | 2213 | 56202 | 56221 | ACTTGCAACAGAGGTTTAGA | 109 | 994 |
| 802821 | 2203 | 2222 | 56211 | 56230 | TTGCAAAACACTTGCAACAG | 120 | 995 |
| 802822 | 2212 | 2231 | 56220 | 56239 | TAGCTACTTTTGCAAAACAC | 88 | 996 |
| 802823 | 2238 | 2257 | 56246 | 56265 | CATCACATTTTTAAGTAAT | 100 | 997 |
| 802824 | 2247 | 2266 | 56255 | 56274 | TCTCTCTAGCATCACATTTT | 80 | 998 |
| 802825 | 2256 | 2275 | 56264 | 56283 | ATCACACGCTCTCTCTAGCA | 57 | 999 |
| 802826 | 2282 | 2301 | 56290 | 56309 | CATTCAACCATGATGCTGTT | 79 | 72 |
| 802827 | 2291 | 2310 | 56299 | 56318 | AGAAGCAAGCATTCAACCAT | 103 | 1000 |
| 802828 | 2300 | 2319 | 56308 | 56327 | GCTCCCAATAGAAGCAAGCA | 108 | 1001 |
| 802829 | 2312 | 2331 | 56320 | 56339 | TGATTGGCATCTGCTCCCAA | 96 | 1002 |
| 802830 | 2313 | 2332 | 56321 | 56340 | TTGATTGGCATCTGCTCCCA | 67 | 1003 |
| 802831 | 2314 | 2333 | 56322 | 56341 | CTTGATTGGCATCTGCTCCC | 87 | 1004 |
| 802832 | 2315 | 2334 | 56323 | 56342 | GCTTGATTGGCATCTGCTCC | 54 | 1005 |
| 802833 | 2316 | 2335 | 56324 | 56343 | TGCTTGATTGGCATCTGCTC | 83 | 1006 |
| 802834 | 2318 | 2337 | 56326 | 56345 | TTTGCTTGATTGGCATCTGC | 82 | 125 |

TABLE 12-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802835 | 2319 | 2338 | 56327 | 56346 | CTTTGCTTGATTGGCATCTG | 80 | 1007 |
| 802836 | 2320 | 2339 | 56328 | 56347 | CCTTTGCTTGATTGGCATCT | 70 | 1008 |
| 802837 | 2321 | 2340 | 56329 | 56348 | TCCTTTGCTTGATTGGCATC | 94 | 1009 |
| 802838 | 2322 | 2341 | 56330 | 56349 | CTCCTTTGCTTGATTGGCAT | 75 | 1010 |
| 802839 | 2326 | 2345 | 56334 | 56353 | ATCCCTCCTTTGCTTGATTG | 124 | 1011 |
| 802840 | 2335 | 2354 | 56343 | 56362 | TTAAAGAAGATCCCTCCTTT | 186 | 1012 |
| 802841 | 2344 | 2363 | 56352 | 56371 | CCTGACAAATTAAAGAAGAT | 148 | 1013 |
| 802842 | 2357 | 2376 | N/A | N/A | TCTTTCTCACATACCTGACA | 69 | 1014 |

TABLE 13

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 693433 | 2380 | 2399 | 62001 | 62020 | GTTCCACCAATTTGGGACTG | 41 | 126 |
| 780254 | 4111 | 4130 | 86606 | 86625 | GTTTCATTCGGTTATAAGGC | 30 | 235 |
| 780254 | 4111 | 4130 | 86606 | 86625 | GTTTCATTCGGTTATAAGGC | 22 | 235 |
| 802843 | 2358 | 2377 | N/A | N/A | CTCTTTCTCACATACCTGAC | 74 | 1015 |
| 802844 | 2360 | 2379 | N/A | N/A | CTCTCTTTCTCACATACCTG | 53 | 1016 |
| 802845 | 2365 | 2384 | 61986 | 62005 | GACTGCTCTCTTTCTCACAT | 34 | 1017 |
| 802846 | 2367 | 2386 | 61988 | 62007 | GGGACTGCTCTCTTTCTCAC | 39 | 1018 |
| 802847 | 2369 | 2388 | 61990 | 62009 | TTGGGACTGCTCTCTTTCTC | 53 | 1019 |
| 802848 | 2370 | 2389 | 61991 | 62010 | TTTGGGACTGCTCTCTTTCT | 59 | 1020 |
| 802849 | 2372 | 2391 | 61993 | 62012 | AATTTGGGACTGCTCTCTTT | 99 | 1021 |
| 802850 | 2373 | 2392 | 61994 | 62013 | CAATTTGGGACTGCTCTCTT | 83 | 1022 |
| 802851 | 2389 | 2408 | 62010 | 62029 | TCAGTAAGAGTTCCACCAAT | 65 | 1023 |
| 802852 | 2415 | 2434 | 62036 | 62055 | TACATCTTGTTCACGAGATC | 92 | 1024 |
| 802853 | 2460 | 2479 | 62081 | 62100 | GATCTGGCTGTCACCTTTCC | 65 | 1025 |
| 802854 | 2469 | 2488 | 62090 | 62109 | CAAGCTGATGATCTGGCTGT | 98 | 1026 |
| 802855 | 2478 | 2497 | 62099 | 62118 | CCTTAAGAGCAAGCTGATGA | 58 | 1027 |
| 802856 | 2487 | 2506 | 62108 | 62127 | GGCCAGCCTCCTTAAGAGCA | 74 | 1028 |
| 802857 | 2508 | 2527 | 62129 | 62148 | GCTATTGTTGGCCACATCCA | 44 | 1029 |
| 802858 | 2517 | 2536 | 62138 | 62157 | AAGGCAAATGCTATTGTTGG | 90 | 1030 |
| 802859 | 2526 | 2545 | 62147 | 62166 | AAATCCTCCAAGGCAAATGC | 92 | 1031 |
| 802860 | 2552 | 2571 | 62173 | 62192 | CAAGAAGGTTCAACTTTTCC | 87 | 1032 |

TABLE 13-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802861 | 2596 | 2615 | 62217 | 62236 | GTTTCCTTAAATTAGAAGTC | 169 | 1033 |
| 802862 | 2606 | 2625 | N/A | N/A | ATATTTGTTTGTTTCCTTAA | 81 | 1034 |
| 802863 | 2615 | 2634 | N/A | N/A | GTAGATGCTATATTTGTTTG | 82 | 1035 |
| 802864 | 2641 | 2660 | 65479 | 65498 | GATATCTGATCACCATTCTT | 78 | 1036 |
| 802865 | 2650 | 2669 | 65488 | 65507 | TTTTCATCTGATATCTGATC | 121 | 1037 |
| 802866 | 2659 | 2678 | 65497 | 65516 | CCACAGCACTTTTCATCTGA | 116 | 1038 |
| 802867 | 2668 | 2687 | 65506 | 65525 | TTCCTTCTTCCACAGCACTT | 115 | 1039 |
| 802868 | 2687 | 2706 | 65525 | 65544 | CCATCGCTGCCTGAGGCTGT | 69 | 1040 |
| 802869 | 2696 | 2715 | 65534 | 65553 | GAAAAATTTCCATCGCTGCC | 149 | 1041 |
| 802870 | 2705 | 2724 | 65543 | 65562 | ACATCTTCAGAAAAATTTCC | 86 | 1042 |
| 802871 | 2731 | 2750 | 65569 | 65588 | AGGTCCATTCATCAAATTTA | 77 | 1043 |
| 802872 | 2740 | 2759 | 65578 | 65597 | CAGGAATAAAGGTCCATTCA | 68 | 1044 |
| 802873 | 2749 | 2768 | 65587 | 65606 | TAGAAGAGTCAGGAATAAAG | 119 | 1045 |
| 802874 | 2761 | 2780 | 65599 | 65618 | ACACACTGTCCATAGAAGAG | 53 | 1046 |
| 802875 | 2763 | 2782 | 65601 | 65620 | AAACACACTGTCCATAGAAG | 102 | 1047 |
| 802876 | 2765 | 2784 | 65603 | 65622 | GCAAACACACTGTCCATAGA | 43 | 1048 |
| 802877 | 2767 | 2786 | 65605 | 65624 | GAGCAAACACACTGTCCATA | 42 | 1049 |
| 802878 | 2768 | 2787 | 65606 | 65625 | TGAGCAAACACACTGTCCAT | 70 | 1050 |
| 802879 | 2770 | 2789 | 65608 | 65627 | TTTGAGCAAACACACTGTCC | 124 | 1051 |
| 802880 | 2771 | 2790 | 65609 | 65628 | CTTTGAGCAAACACACTGTC | 141 | 1052 |
| 802881 | 2778 | 2797 | 65616 | 65635 | GTCATCACTTTGAGCAAACA | 90 | 1053 |
| 802882 | 2787 | 2806 | 65625 | 65644 | ACTATCCAGGTCATCACTTT | 121 | 1054 |
| 802883 | 2796 | 2815 | N/A | N/A | ACTTCCTTCACTATCCAGGT | 53 | 1055 |
| 802884 | 2819 | 2838 | 71662 | 71681 | TTTTTCACAAGAAATGAGCC | 96 | 1056 |
| 802885 | 2828 | 2847 | 71671 | 71690 | TTAGATTTCTTTTTCACAAG | 116 | 1057 |
| 802886 | 2837 | 2856 | 71680 | 71699 | CTAATTGAATTAGATTTCTT | 106 | 1058 |
| 802887 | 2863 | 2882 | 71706 | 71725 | CGGCATCTCGGTAAAATTCT | 48 | 1059 |
| 802888 | 2872 | 2891 | 71715 | 71734 | GCTGTAATACGGCATCTCGG | 27 | 1060 |
| 802889 | 2907 | 2926 | 71750 | 71769 | GGAATTGGAATGTCTTTGCA | 76 | 1061 |
| 802890 | 2916 | 2935 | N/A | N/A | GGGCCCCAAGGAATTGGAAT | 102 | 1062 |
| 802891 | 2925 | 2944 | N/A | N/A | ATCAAAAATGGGCCCCAAGG | 87 | 1063 |
| 802892 | 2951 | 2970 | 72975 | 72994 | CTTTTTCGCTTCAGTAAATC | 79 | 1064 |
| 802893 | 2962 | 2981 | 72986 | 73005 | ATAATATTTTCTTTTTCGC | 109 | 1065 |
| 802894 | 2971 | 2990 | 72995 | 73014 | CATCTGAAGATAATATTTTT | 141 | 1066 |
| 802895 | 2995 | 3014 | N/A | N/A | GAAGTTTTGATGACCTGAGT | 108 | 1067 |

TABLE 13-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802896 | 3004 | 3023 | 73540 | 73559 | TATGGGATTGAAGTTTTGAT | 56 | 1068 |
| 802897 | 3013 | 3032 | 73549 | 73568 | AATGCCTCATATGGGATTGA | 93 | 1069 |
| 802898 | 3022 | 3041 | 73558 | 73577 | TGCTGTCTGAATGCCTCATA | 60 | 1070 |
| 802899 | 3040 | 3059 | 73576 | 73595 | CAGAAGCCAGAGAAGAAATG | 135 | 1071 |
| 802900 | 3049 | 3068 | 73585 | 73604 | ATTCTCTCTCAGAAGCCAGA | 53 | 1072 |
| 802901 | 3058 | 3077 | 73594 | 73613 | ATGTAATATATTCTCTCTCA | 52 | 1073 |
| 802902 | 3084 | 3103 | 73620 | 73639 | TAGTTCATTTGCTGAAAGGT | 66 | 1074 |
| 802903 | 3093 | 3112 | 73629 | 73648 | AATATCTCTTAGTTCATTTG | 146 | 1075 |
| 802904 | 3102 | 3121 | 73638 | 73657 | TAGGGCATCAATATCTCTTA | 40 | 1076 |
| 802905 | 3111 | 3130 | 73647 | 73666 | TTTCTGGCTTAGGGCATCAA | 133 | 1077 |
| 802906 | 3129 | 3148 | 73665 | 73684 | ATGAACACTTATACAGCATT | 114 | 1078 |
| 802907 | 3138 | 3157 | 73674 | 73693 | ATGCTCCAAATGAACACTTA | 124 | 1079 |
| 802908 | 3147 | 3166 | 73683 | 73702 | CTTTTCAAGATGCTCCAAAT | 170 | 1080 |
| 802909 | 3173 | 3192 | 73709 | 73728 | GTGAGTGCATTCTGGTGAAG | 72 | 1081 |
| 802910 | 3192 | 3211 | 73728 | 73747 | TAGCTGTTGTGGAAAGCTCG | 114 | 1082 |
| 802911 | 3217 | 3236 | N/A | N/A | GTGTCAAACTCTTCAGAGTT | 34 | 1083 |
| 802912 | 3218 | 3237 | 76352 | 76371 | TGTGTCAAACTCTTCAGAGT | 60 | 1084 |
| 802913 | 3219 | 3238 | 76353 | 76372 | ATGTGTCAAACTCTTCAGAG | 63 | 1085 |
| 802914 | 3220 | 3239 | 76354 | 76373 | AATGTGTCAAACTCTTCAGA | 99 | 1086 |
| 802915 | 3226 | 3245 | 76360 | 76379 | AGTCCAAATGTGTCAAACTC | 23 | 1087 |
| 802916 | 3235 | 3254 | 76369 | 76388 | TACTGTGCAAGTCCAAATGT | 119 | 1088 |
| 802917 | 3244 | 3263 | 76378 | 76397 | TAAATTTATTACTGTGCAAG | 55 | 1089 |
| 802918 | 3265 | 3284 | 76399 | 76418 | ACAAATAAGAAGGAAATGAT | 196 | 1090 |

TABLE 14

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 22 | 235 |
| 780254 | 4111 | 4130 | 86606 | 86625 | GTTTCATTCGGTTATAAGGC | 29 | 235 |
| 802919 | 3274 | 3293 | 76408 | 76427 | TCATTTTCAACAAATAAGAA | 110 | 1091 |
| 802920 | 3283 | 3302 | 76417 | 76436 | CAATACAACTCATTTTCAAC | 63 | 1092 |
| 802921 | 3309 | 3328 | 76443 | 76462 | GTCATTTCGAGAGACATCAA | 36 | 1093 |
| 802922 | 3318 | 3337 | 76452 | 76471 | GGGTCCAATGTCATTTCGAG | 38 | 1094 |

TABLE 14-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802923 | 3327 | 3346 | 76461 | 76480 | AACCACTGAGGGTCCAATGT | 51 | 1095 |
| 802924 | 3353 | 3372 | 76487 | 76506 | GTTGGACATTTCACTGTAGG | 20 | 1096 |
| 802925 | 3362 | 3381 | 76496 | 76515 | TGTTTCAGAGTTGGACATTT | 77 | 1097 |
| 802926 | 3371 | 3390 | 76505 | 76524 | AGGTTAAACTGTTTCAGAGT | 36 | 1098 |
| 802927 | 3380 | 3399 | 76514 | 76533 | TTATATGACAGGTTAAACTG | 103 | 1099 |
| 802928 | 3398 | 3417 | 76532 | 76551 | GGTACAAAAGACAGCTGGTT | 34 | 1100 |
| 802929 | 3407 | 3426 | 76541 | 76560 | AGGTTCTCAGGTACAAAAGA | 47 | 1101 |
| 802930 | 3416 | 3435 | 76550 | 76569 | ACATCAGTGAGGTTCTCAGG | 37 | 1102 |
| 802931 | 3442 | 3461 | 76576 | 76595 | AAATGAGCTGCTCCAGTTTC | 75 | 1103 |
| 802932 | 3451 | 3470 | N/A | N/A | TTCCTTCTAAAATGAGCTGC | 53 | 1104 |
| 802933 | 3463 | 3482 | N/A | N/A | CTGATATTTTATTTCCTTCT | 69 | 1105 |
| 802934 | 3472 | 3491 | 77221 | 77240 | AGCATATCCCTGATATTTTA | 29 | 1106 |
| 802935 | 3495 | 3514 | 77244 | 77263 | CAGTTCCTTCAGTCTCAAGG | 32 | 1107 |
| 802936 | 3496 | 3515 | 77245 | 77264 | TCAGTTCCTTCAGTCTCAAG | 49 | 1108 |
| 802937 | 3497 | 3516 | 77246 | 77265 | TTCAGTTCCTTCAGTCTCAA | 80 | 1109 |
| 802938 | 3498 | 3517 | 77247 | 77266 | CTTCAGTTCCTTCAGTCTCA | 37 | 1110 |
| 802939 | 3499 | 3518 | 77248 | 77267 | TCTTCAGTTCCTTCAGTCTC | 56 | 1111 |
| 802940 | 3505 | 3524 | 77254 | 77273 | TTAAAATCTTCAGTTCCTTC | 59 | 1112 |
| 802941 | 3514 | 3533 | 77263 | 77282 | TACTAAGGTTTAAAATCTTC | 105 | 1113 |
| 802942 | 3523 | 3542 | 77272 | 77291 | TGTGGTTCTTACTAAGGTTT | 38 | 1114 |
| 802943 | 3547 | 3566 | 77296 | 77315 | GAAAGTTCTCTGATAGGGAT | 59 | 1115 |
| 802944 | 3556 | 3575 | 77305 | 77324 | AAGCCTCAAGAAAGTTCTCT | 59 | 1116 |
| 802945 | 3565 | 3584 | 77314 | 77333 | CTTTAGGACAAGCCTCAAGA | 65 | 132 |
| 802946 | 3591 | 3610 | 77340 | 77359 | ATTCATTCTGGCACTGAAAC | 136 | 1117 |
| 802947 | 3600 | 3619 | N/A | N/A | AGCAAGAAAATTCATTCTGG | 75 | 1118 |
| 802948 | 3609 | 3628 | N/A | N/A | AGGCATAGCAGCAAGAAAAT | 57 | 1119 |
| 802949 | 3635 | 3654 | 80915 | 80934 | AGGATTGTCATAGAAGGAGG | 19 | 1120 |
| 802950 | 3644 | 3663 | 80924 | 80943 | GATAATTTAGGATTGTCAT | 58 | 1121 |
| 802951 | 3654 | 3673 | 80934 | 80953 | TTTGTTCTGAGATAATTTTA | 32 | 1122 |
| 802952 | 3679 | 3698 | 80959 | 80978 | AAATTGCTTCTGGAATACAG | 75 | 1123 |
| 802953 | 3688 | 3707 | 80968 | 80987 | GAAGATTTAAAATTGCTTCT | 115 | 1124 |
| 802954 | 3697 | 3716 | N/A | N/A | GCAAGTGTGGAAGATTTAAA | 50 | 1125 |
| 802955 | 3709 | 3728 | N/A | N/A | TATCTAAAGACCGCAAGTGT | 51 | 1126 |
| 802956 | 3710 | 3729 | N/A | N/A | ATATCTAAAGACCGCAAGTG | 62 | 1127 |
| 802957 | 3711 | 3730 | N/A | N/A | CATATCTAAAGACCGCAAGT | 63 | 1128 |

TABLE 14-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802958 | 3712 | 3731 | 82057 | 82076 | TCATATCTAAAGACCGCAAG | 71 | 1129 |
| 802959 | 3713 | 3732 | 82058 | 82077 | CTCATATCTAAAGACCGCAA | 47 | 1130 |
| 802960 | 3715 | 3734 | 82060 | 82079 | TGCTCATATCTAAAGACCGC | 35 | 1131 |
| 802961 | 3716 | 3735 | 82061 | 82080 | CTGCTCATATCTAAAGACCG | 43 | 1132 |
| 802962 | 3717 | 3736 | 82062 | 82081 | GCTGCTCATATCTAAAGACC | 28 | 1133 |
| 802963 | 3718 | 3737 | 82063 | 82082 | TGCTGCTCATATCTAAAGAC | 64 | 1134 |
| 802964 | 3719 | 3738 | 82064 | 82083 | TTGCTGCTCATATCTAAAGA | 79 | 1135 |
| 802965 | 3723 | 3742 | 82068 | 82087 | ATCATTGCTGCTCATATCTA | 82 | 1136 |
| 802966 | 3732 | 3751 | 82077 | 82096 | GTACTGAATATCATTGCTGC | 31 | 1137 |
| 802967 | 3741 | 3760 | 82086 | 82105 | ACCTGGTAGGTACTGAATAT | 50 | 1138 |
| 802968 | 3767 | 3786 | 82112 | 82131 | AAGTTCAAAGATTTCCAGTG | 50 | 1139 |
| 802969 | 3776 | 3795 | 82121 | 82140 | AGTTCCCTTAAGTTCAAAGA | 78 | 1140 |
| 802970 | 3785 | 3804 | 82130 | 82149 | CTAAATAAGAGTTCCCTTAA | 75 | 1141 |
| 802971 | 3811 | 3830 | 82156 | 82175 | AGTCCAAGATGCTGATCTGA | 49 | 1142 |
| 802972 | 3820 | 3839 | 82165 | 82184 | TTTCACTCAAGTCCAAGATG | 52 | 1143 |
| 802973 | 3829 | 3848 | 82174 | 82193 | AATATGCTTTTCACTCAAG | 64 | 1144 |
| 802974 | 3855 | 3874 | 82200 | 82219 | ATGCAGTTTCTCTACTCTAG | 31 | 1145 |
| 802975 | 3864 | 3883 | 82209 | 82228 | GTGAGAAAGATGCAGTTTCT | 47 | 1146 |
| 802976 | 3873 | 3892 | 82218 | 82237 | CAGTTTATTGTGAGAAAGAT | 89 | 1147 |
| 802977 | 3882 | 3901 | N/A | N/A | AATCTCTTTCAGTTTATTGT | 65 | 1148 |
| 802978 | 3900 | 3919 | 83895 | 83914 | ACAGCCAATCTCAGGAGGAA | 56 | 1149 |
| 802979 | 3909 | 3928 | 83904 | 83923 | ATTTTCAAGACAGCCAATCT | 72 | 1150 |
| 802980 | 3918 | 3937 | 83913 | 83932 | AGATGTCAGATTTTCAAGAC | 141 | 1151 |
| 802981 | 3944 | 3963 | 83939 | 83958 | AGTTCCAAGTTGTAACTGAC | 59 | 57 |
| 802982 | 3953 | 3972 | 83948 | 83967 | AAGGATCTTAGTTCCAAGTT | 89 | 1152 |
| 802983 | 3962 | 3981 | 83957 | 83976 | TCATTGGGAAAGGATCTTAG | 107 | 1153 |
| 802984 | 3988 | 4007 | 83983 | 84002 | CCCATATTTTGCTTAATTTC | 54 | 1154 |
| 802985 | 3997 | 4016 | 83992 | 84011 | AAGGAAGATCCCATATTTTG | 72 | 1155 |
| 802986 | 4006 | 4025 | 84001 | 84020 | GTTCATCCAAAGGAAGATCC | 40 | 1156 |
| 802987 | 4033 | 4052 | 84028 | 84047 | TATGTTTAAAATCAAAGTTA | 128 | 1157 |
| 802988 | 4042 | 4061 | 84037 | 84056 | TACATCCTATATGTTTAAAA | 101 | 1158 |
| 802989 | 4060 | 4079 | 84055 | 84074 | TTATGATGTCTTTGGCTTTA | 41 | 1159 |
| 802990 | 4061 | 4080 | 84056 | 84075 | CTTATGATGTCTTTGGCTTT | 53 | 1160 |
| 802991 | 4063 | 4082 | 84058 | 84077 | ACCTTATGATGTCTTTGGCT | 36 | 1161 |
| 802992 | 4065 | 4084 | N/A | N/A | AAACCTTATGATGTCTTTGG | 41 | 1162 |
| 802993 | 4068 | 4087 | N/A | N/A | AAGAAACCTTATGATGTCTT | 80 | 1163 |

TABLE 14-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 802994 | 4078 | 4097 | N/A | N/A | ATCGCTGTTGAAGAAACCTT | 38 | 1164 |
| 802995 | 4087 | 4106 | 86582 | 86601 | CCTTTTTTAATCGCTGTTGA | 69 | 1165 |

TABLE 15

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 31 | 235 |
| 780254 | 4111 | 4130 | 86606 | 86625 | GTTTCATTCGGTTATAAGGC | 51 | 235 |
| 802996 | 4096 | 4115 | 86591 | 86610 | AAGGCACAGCCTTTTTTAAT | 88 | 1166 |
| 802997 | 4106 | 4125 | 86601 | 86620 | ATTCGGTTATAAGGCACAGC | 39 | 1167 |
| 802998 | 4107 | 4126 | 86602 | 86621 | CATTCGGTTATAAGGCACAG | 54 | 1168 |
| 802999 | 4108 | 4127 | 86603 | 86622 | TCATTCGGTTATAAGGCACA | 51 | 1169 |
| 803000 | 4109 | 4128 | 86604 | 86623 | TTCATTCGGTTATAAGGCAC | 34 | 1170 |
| 803001 | 4110 | 4129 | 86605 | 86624 | TTTCATTCGGTTATAAGGCA | 47 | 1171 |
| 803002 | 4112 | 4131 | 86607 | 86626 | AGTTTCATTCGGTTATAAGG | 57 | 1172 |
| 803003 | 4113 | 4132 | 86608 | 86627 | AAGTTTCATTCGGTTATAAG | 72 | 1173 |
| 803004 | 4114 | 4133 | 86609 | 86628 | TAAGTTTCATTCGGTTATAA | 89 | 1174 |
| 803005 | 4115 | 4134 | 86610 | 86629 | ATAAGTTTCATTCGGTTATA | 44 | 1175 |
| 803006 | 4116 | 4135 | 86611 | 86630 | CATAAGTTTCATTCGGTTAT | 45 | 1176 |
| 803007 | 4120 | 4139 | 86615 | 86634 | CAATCATAAGTTTCATTCGG | 51 | 1177 |
| 803008 | 4129 | 4148 | 86624 | 86643 | TATTTCCCACAATCATAAGT | 98 | 1178 |
| 803009 | 4138 | 4157 | 86633 | 86652 | CACTCCCAGTATTTCCCACA | 69 | 1179 |
| 803010 | 4164 | 4183 | 86659 | 86678 | TAATTGCTGCAATAAGGTGG | 51 | 1180 |
| 803011 | 4173 | 4192 | 86668 | 86687 | GGTTTTCATTAATTGCTGCA | 40 | 1181 |
| 803012 | 4184 | 4203 | 86679 | 86698 | TCTGATTTCTTGGTTTTCAT | 58 | 1182 |
| 803013 | 4208 | 4227 | 86703 | 86722 | ACTGTGGCACTTTGCATTCC | 80 | 1183 |
| 803014 | 4217 | 4236 | 86712 | 86731 | TCTATGCCAACTGTGGCACT | 79 | 1184 |
| 803015 | 4226 | 4245 | 86721 | 86740 | TCTTTCACATCTATGCCAAC | 79 | 1185 |
| 803016 | 4252 | 4271 | 86747 | 86766 | TTTTGTCTCTTATTTGGATA | 44 | 1186 |
| 803017 | 4267 | 4286 | 86762 | 86781 | CGAGATCTCTCTTTCTTTTG | 56 | 1187 |
| 803018 | 4276 | 4295 | 86771 | 86790 | CATTTAGGACGAGATCTCTC | 92 | 1188 |
| 803019 | 4296 | 4315 | N/A | N/A | ACGACCTGCAAAATCCCACA | 65 | 1189 |

TABLE 15-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803020 | 4305 | 4324 | N/A | N/A | GAATTCCTCACGACCTGCAA | 90 | 83 |
| 803021 | 4314 | 4333 | 87218 | 87237 | AGTACTATAGAATTCCTCAC | 35 | 1190 |
| 803022 | 4359 | 4378 | 87263 | 87282 | ATAGACAGCAAGGTACAATG | 101 | 1191 |
| 803023 | 4368 | 4387 | 87272 | 87291 | GCTGAGGTCATAGACAGCAA | 101 | 1192 |
| 803024 | 4377 | 4396 | 87281 | 87300 | CTGTCCCTTGCTGAGGTCAT | 89 | 1193 |
| 803025 | 4403 | 4422 | 87307 | 87326 | CAAGGCTTCATGGCATCAAC | 85 | 1194 |
| 803026 | 4412 | 4431 | 87316 | 87335 | TTGAAGAGCCAAGGCTTCAT | 96 | 1195 |
| 803027 | 4421 | 4440 | N/A | N/A | GCCTTTATATTGAAGAGCCA | 62 | 1196 |
| 803028 | 4456 | 4475 | 88557 | 88576 | TGCCAACGAGAATCACAGGG | 45 | 1197 |
| 803029 | 4465 | 4484 | 88566 | 88585 | CCAAATGTGTGCCAACGAGA | 70 | 1198 |
| 803030 | 4474 | 4493 | 88575 | 88594 | CAGAAACATCCAAATGTGTG | 69 | 1199 |
| 803031 | 4505 | 4524 | 88606 | 88625 | TTACTCATGCAGGCTTTGCG | 44 | 1200 |
| 803032 | 4514 | 4533 | 88615 | 88634 | TTGGTGATTTTACTCATGCA | 43 | 1201 |
| 803033 | 4536 | 4555 | 88637 | 88656 | CCCTCGCTTATTCAGGAGTT | 98 | 1202 |
| 803034 | 4545 | 4564 | 88646 | 88665 | GGCAGGGAACCCTCGCTTAT | 61 | 1203 |
| 803035 | 4580 | 4599 | 88681 | 88700 | TCCTCGGTGGCATTCACAAA | 60 | 42 |
| 803036 | 4589 | 4608 | 88690 | 88709 | GCATCAGATTCCTCGGTGGC | 39 | 1204 |
| 803037 | 4598 | 4617 | 88699 | 88718 | TTTGCCAAAGCATCAGATTC | 67 | 1205 |
| 803038 | 4639 | 4658 | N/A | N/A | TCTTGAAATTAAGGCTCTCG | 91 | 1206 |
| 803039 | 4648 | 4667 | N/A | N/A | GATCTCGGATCTTGAAATTA | 125 | 1207 |
| 803040 | 4668 | 4687 | 92091 | 92110 | CAGCTGTCCAACAACAAGCT | 81 | 1208 |
| 803041 | 4677 | 4696 | 92100 | 92119 | GTCTGGAATCAGCTGTCCAA | 55 | 1209 |
| 803042 | 4686 | 4705 | 92109 | 92128 | TACATAGCAGTCTGGAATCA | 75 | 1210 |
| 803043 | 4712 | 4731 | 92135 | 92154 | TCCGATAAAATGATTTTTTC | 60 | 1211 |
| 803044 | 4721 | 4740 | 92144 | 92163 | TTTTTACGCTCCGATAAAAT | 132 | 1212 |
| 803045 | 4730 | 4749 | 92153 | 92172 | ATTGGCACATTTTTACGCTC | 24 | 1213 |
| 803046 | 4756 | 4775 | 92179 | 92198 | GTTTCCGGTCAATTACGGGA | 21 | 1214 |
| 803047 | 4775 | 4794 | 92198 | 92217 | CTCACTAGTTGTAATAATCG | 63 | 1215 |
| 803048 | 4800 | 4819 | 92223 | 92242 | TTCATCTAACTGCAGCTGAT | 59 | 1216 |
| 803049 | 4810 | 4829 | 92233 | 92252 | GAAGCTCATTTTCATCTAAC | 49 | 1217 |
| 803050 | 4844 | 4863 | N/A | N/A | ACTCCTGATTCATTTAGAAA | 88 | 1218 |
| 803051 | 4853 | 4872 | N/A | N/A | TGAAGAAGGACTCCTGATTC | 99 | 1219 |
| 803052 | 4862 | 4881 | 93323 | 93342 | TCTTGAAAATGAAGAAGGAC | 100 | 1220 |
| 803053 | 4871 | 4890 | 93332 | 93351 | AGTGCTGGGTCTTGAAAATG | 55 | 1221 |
| 803054 | 4892 | 4911 | 93353 | 93372 | AAGTACAAGTCACTTAACTG | 38 | 1222 |
| 803055 | 4938 | 4957 | N/A | N/A | TGTCAAAATCTGTGCCATGA | 70 | 1223 |

TABLE 15-continued

Percent control of human LRRK2 RNA with 5-10-5 MOE gapmers
with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803056 | 4947 | 4966 | 98095 | 98114 | CACTTTCACTGTCAAAATCT | 76 | 1224 |
| 803057 | 4956 | 4975 | 98104 | 98123 | ACAACCTTCCACTTTCACTG | 65 | 1225 |
| 803058 | 4982 | 5001 | 98130 | 98149 | GAAATAATGCCCTTAGGGTG | 98 | 1226 |
| 803059 | 4991 | 5010 | 98139 | 98158 | TCTCTACGCGAAATAATGCC | 58 | 1227 |
| 803060 | 5000 | 5019 | 98148 | 98167 | TTTTCCACATCTCTACGCGA | 49 | 1228 |
| 803061 | 5009 | 5028 | 98157 | 98176 | GAAAGAAATTTTCCACATC | 65 | 1229 |
| 803062 | 5028 | 5047 | 98176 | 98195 | TGGAAATTTCCTTTTTTTG | 81 | 1230 |
| 803063 | 5038 | 5057 | 98186 | 98205 | TGTAGTTCTTTGGAAATTTC | 45 | 1231 |
| 803064 | 5047 | 5066 | 98195 | 98214 | ACTGTGACATGTAGTTCTTT | 29 | 1232 |
| 803065 | 5072 | 5091 | 98220 | 98239 | TGGAATTTTTCTAGGAGCTT | 23 | 1233 |
| 803066 | 5082 | 5101 | 98230 | 98249 | CAAAGCAATCTGGAATTTTT | 104 | 1234 |
| 803067 | 5091 | 5110 | 98239 | 98258 | TCCTATTGGCAAAGCAATCT | 79 | 1235 |
| 803068 | 5100 | 5119 | 98248 | 98267 | ATATTCTTCTCCTATTGGCA | 84 | 1236 |
| 803069 | 5118 | 5137 | N/A | N/A | ACTGCTTGGAACCAGCAAAT | 72 | 1237 |
| 803070 | 5127 | 5146 | N/A | N/A | GTCAGACAAACTGCTTGGAA | 84 | 1238 |
| 803071 | 5136 | 5155 | 99142 | 99161 | AGGCCTGTGGTCAGACAAAC | 87 | 1239 |
| 803072 | 5145 | 5164 | 99151 | 99170 | CTCTATCACAGGCCTGTGGT | 73 | 1240 |

TABLE 16

Percent control of human LRRK2 RNA with 5-10-5 MOE gapmers
with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 11 | 235 |
| 780254 | 4111 | 4130 | 86606 | 86625 | GTTTCATTCGGTTATAAGGC | 26 | 235 |
| 803073 | 5178 | 5197 | 99184 | 99203 | GATGATAATTTCAGAGTTCT | 49 | 1241 |
| 803074 | 5187 | 5206 | 99193 | 99212 | ATATAGTCGGATGATAATTT | 53 | 1242 |
| 803075 | 5196 | 5215 | 99202 | 99221 | AGGCATTTCATATAGTCGGA | 11 | 1243 |
| 803076 | 5206 | 5225 | 99212 | 99231 | TTGGAAAATAAGGCATTTCA | 48 | 1244 |
| 803077 | 5227 | 5246 | 99233 | 99252 | TTAATCTTGACCAAAATCCC | 76 | 1245 |
| 803078 | 5236 | 5255 | 99242 | 99261 | ATCGATTGATTAATCTTGAC | 48 | 1246 |
| 803079 | 5245 | 5264 | 99251 | 99270 | TCTCAAGTAATCGATTGATT | 34 | 1247 |
| 803080 | 5270 | 5289 | 99276 | 99295 | CTCCCTGAAAGCATGTAAGG | 64 | 1248 |
| 803081 | 5294 | 5313 | 100146 | 100165 | CTGTTTGGGCGAAGTGCTCG | 45 | 1249 |

TABLE 16-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803082 | 5300 | 5319 | 100152 | 100171 | TACATTCTGTTTGGGCGAAG | 52 | 1250 |
| 803083 | 5301 | 5320 | 100153 | 100172 | ATACATTCTGTTTGGGCGAA | 40 | 1251 |
| 803084 | 5302 | 5321 | 100154 | 100173 | AATACATTCTGTTTGGGCGA | 33 | 1252 |
| 803085 | 5303 | 5322 | 100155 | 100174 | CAATACATTCTGTTTGGGCG | 39 | 1253 |
| 803086 | 5304 | 5323 | 100156 | 100175 | CCAATACATTCTGTTTGGGC | 48 | 1254 |
| 803087 | 5306 | 5325 | 100158 | 100177 | CGCCAATACATTCTGTTTGG | 36 | 1255 |
| 803088 | 5307 | 5326 | 100159 | 100178 | TCGCCAATACATTCTGTTTG | 44 | 1256 |
| 803089 | 5308 | 5327 | 100160 | 100179 | GTCGCCAATACATTCTGTTT | 57 | 1257 |
| 803090 | 5309 | 5328 | 100161 | 100180 | TGTCGCCAATACATTCTGTT | 55 | 1258 |
| 803091 | 5310 | 5329 | 100162 | 100181 | TTGTCGCCAATACATTCTGT | 62 | 1259 |
| 803092 | 5314 | 5333 | 100166 | 100185 | TGCCTTGTCGCCAATACATT | 46 | 1260 |
| 803093 | 5323 | 5342 | 100175 | 100194 | TTAAGTAAATGCCTTGTCGC | 61 | 1261 |
| 803094 | 5332 | 5351 | 100184 | 100203 | GAGACCAATTTAAGTAAATG | 63 | 1262 |
| 803095 | 5358 | 5377 | 100210 | 100229 | AGATCCTACCAGACAATAAG | 83 | 1263 |
| 803096 | 5367 | 5386 | 100219 | 100238 | TAAGACTTCAGATCCTACCA | 49 | 1264 |
| 803097 | 5376 | 5395 | 100228 | 100247 | ATGATTGTCTAAGACTTCAG | 38 | 1265 |
| 803098 | 5385 | 5404 | 100237 | 100256 | ACTCTCTGGATGATTGTCTA | 36 | 1266 |
| 803099 | 5405 | 5424 | 100257 | 100276 | GGAACTGTAATTTTTAAGAA | 98 | 1267 |
| 803100 | 5414 | 5433 | 100266 | 100285 | CTACAAGAAGGAACTGTAAT | 98 | 1268 |
| 803101 | 5423 | 5442 | N/A | N/A | CAGCCTTTTCTACAAGAAGG | 40 | 1269 |
| 803102 | 5449 | 5468 | 100438 | 100457 | GGTCCACAACTTGGCCCAAA | 28 | 1270 |
| 803103 | 5458 | 5477 | 100447 | 100466 | AATCAATGTGGTCCACAACT | 70 | 1271 |
| 803104 | 5467 | 5486 | 100456 | 100475 | CCATGAGAGAATCAATGTGG | 35 | 1272 |
| 803105 | 5476 | 5495 | 100465 | 100484 | ACCATTCTTCCATGAGAGAA | 36 | 1273 |
| 803106 | 5497 | 5516 | 100486 | 100505 | CAATCTCCAGCAACCCAGGA | 69 | 1274 |
| 803107 | 5507 | 5526 | 100496 | 100515 | CCACAAATATCAATCTCCAG | 45 | 1275 |
| 803108 | 5516 | 5535 | 100505 | 100524 | TCTCCTTCACCACAAATATC | 46 | 1276 |
| 803109 | 5533 | 5552 | 100522 | 100541 | ATTTCTTCAACAGAGTTTCT | 103 | 1277 |
| 803110 | 5534 | 5553 | 100523 | 100542 | CATTTCTTCAACAGAGTTTC | 64 | 1278 |
| 803111 | 5536 | 5555 | 100525 | 100544 | CCCATTTCTTCAACAGAGTT | 36 | 1279 |
| 803112 | 5538 | 5557 | 100527 | 100546 | TGCCCATTTCTTCAACAGAG | 22 | 1280 |
| 803113 | 5540 | 5559 | 100529 | 100548 | AATGCCCATTTCTTCAACAG | 53 | 1281 |
| 803114 | 5541 | 5560 | 100530 | 100549 | TAATGCCCATTTCTTCAACA | 67 | 1282 |
| 803115 | 5551 | 5570 | 100540 | 100559 | TAAAACTATATAATGCCCAT | 49 | 1283 |
| 803116 | 5560 | 5579 | 100549 | 100568 | CACCATCATTAAAACTATAT | 72 | 1284 |
| 803117 | 5586 | 5605 | 100575 | 100594 | ATCAAGTAAGATTTTTGAT | 84 | 1285 |

TABLE 16-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803118 | 5595 | 5614 | 100584 | 100603 | CATCAAGTCATCAAGTAAGA | 70 | 1286 |
| 803119 | 5604 | 5623 | 100593 | 100612 | TGCTTTCTTCATCAAGTCAT | 80 | 1287 |
| 803120 | 5631 | 5650 | 101269 | 101288 | TGGATTTACTAAGAGATCTC | 36 | 1288 |
| 803121 | 5640 | 5659 | 101278 | 101297 | TGGTTGATCTGGATTTACTA | 49 | 1289 |
| 803122 | 5649 | 5668 | 101287 | 101306 | GGTGAGCCTTGGTTGATCTG | 28 | 1290 |
| 803123 | 5689 | 5708 | 101327 | 101346 | CAGCCAAAATCAAGTCAGGG | 29 | 1291 |
| 803124 | 5698 | 5717 | 101336 | 101355 | TAGGCAGGTCAGCCAAAATC | 47 | 1292 |
| 803125 | 5721 | 5740 | 101359 | 101378 | ATCATTATTCAACATAATAT | 78 | 1293 |
| 803126 | 5730 | 5749 | 101368 | 101387 | TTCCAACTCATCATTATTCA | 37 | 1294 |
| 803127 | 5739 | 5758 | 101377 | 101396 | TTGTTCAAATTCCAACTCAT | 79 | 1295 |
| 803128 | 5763 | 5782 | N/A | N/A | ATCACCTAGGAGAAACTCTG | 52 | 1296 |
| 803129 | 5772 | 5791 | N/A | N/A | AAAACTGCCATCACCTAGGA | 60 | 1297 |
| 803130 | 5781 | 5800 | 106472 | 106491 | AACTGATCCAAAACTGCCAT | 51 | 1298 |
| 803131 | 5807 | 5826 | 106498 | 106517 | TCTTCTCCTTCATAGGCTGC | 55 | 1299 |
| 803132 | 5816 | 5835 | 106507 | 106526 | ACAGCCACTTCTTCTCCTTC | 80 | 1300 |
| 803133 | 5825 | 5844 | 106516 | 106535 | AAAATCTTCACAGCCACTTC | 102 | 92 |
| 803134 | 5851 | 5870 | 106542 | 106561 | ACAGCCTGAGTGATGTATGT | 32* | 1301 |
| 803135 | 5860 | 5879 | 106551 | 106570 | CTTGTCTTAACAGCCTGAGT | 28* | 1302 |
| 803136 | 5869 | 5888 | N/A | N/A | CCACAAGCTCTTGTCTTAAC | 34* | 1303 |
| 803137 | 5909 | 5928 | 113106 | 113125 | AGCAAAGATATCAAACTGGG | 51* | 1304 |
| 803138 | 5918 | 5937 | 113115 | 113134 | CCAGCTGCCAGCAAAGATAT | 44* | 1305 |
| 803139 | 5927 | 5946 | 113124 | 113143 | GGACGAATCCCAGCTGCCAG | 42* | 1306 |
| 803140 | 5955 | 5974 | 113152 | 113171 | GGAGGCTAACTCCATCACCA | 35 | 1307 |
| 803141 | 5964 | 5983 | 113161 | 113180 | GGAACCCTTGGAGGCTAACT | 89 | 1308 |
| 803142 | 5973 | 5992 | 113170 | 113189 | GCGATCCAAGGAACCCTTGG | 91 | 1309 |
| 803143 | 5999 | 6018 | 113196 | 113215 | AGGCTGGCTTTGTCCTGCTG | 110 | 1310 |
| 803144 | 6008 | 6027 | 113205 | 113224 | GTTCTAGTGAGGCTGGCTTT | 75 | 1311 |
| 803145 | 6017 | 6036 | 113214 | 113233 | TGCTGTAGGGTTCTAGTGAG | 93 | 1312 |
| 803146 | 6052 | 6071 | N/A | N/A | ATCTCAAACCATCAGCTACG | 76 | 1313 |
| 803147 | 6061 | 6080 | N/A | N/A | AGTGGAGGTATCTCAAACCA | 85 | 1314 |
| 803148 | 6087 | 6106 | 118420 | 118439 | CAGGTCTCGGTATATAATCA | 69 | 1315 |
| 803149 | 6111 | 6130 | 118444 | 118463 | GAAAAGCAGCACATTGTGGG | 47 | 1316 |

TABLE 17

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 12 | 235 |
| 780254 | 4111 | 4130 | 86606 | 86625 | GTTTCATTCGGTTATAAGGC | 24 | 235 |
| 803150 | 6131 | 6150 | 118464 | 118483 | GCAGCATTGGGATACAGTGT | 53 | 1317 |
| 803151 | 6140 | 6159 | 118473 | 118492 | GCAATGATGGCAGCATTGGG | 59 | 1318 |
| 803152 | 6149 | 6168 | 118482 | 118501 | GCAATCTTTGCAATGATGGC | 56 | 159 |
| 803153 | 6189 | 6208 | 118522 | 118541 | TATCCCCATTCTACAGCAGT | 81 | 1319 |
| 803154 | 6198 | 6217 | 118531 | 118550 | TGATGTTTTTATCCCCATTC | 98 | 1320 |
| 803155 | 6220 | 6239 | N/A | N/A | CACGAAACCCTGGTGTGCCC | 53 | 1321 |
| 803156 | 6229 | 6248 | 124860 | 124879 | CTTCAGGTGCACGAAACCCT | 101 | 1322 |
| 803157 | 6238 | 6257 | 124869 | 124888 | CTCTGGCAACTTCAGGTGCA | 65 | 1323 |
| 803158 | 6264 | 6283 | 124895 | 124914 | AGCCTGTTGGTTATAAATGA | 64 | 1324 |
| 803159 | 6273 | 6292 | 124904 | 124923 | ATAAACATCAGCCTGTTGGT | 83 | 1325 |
| 803160 | 6282 | 6301 | 124913 | 124932 | ACCAAATGAATAAACATCAG | 60 | 1326 |
| 803161 | 6308 | 6327 | 124939 | 124958 | GTTGTCAAAATGTCATAGAG | 57 | 1327 |
| 803162 | 6317 | 6336 | 124948 | 124967 | CTACCTCCAGTTGTCAAAAT | 72 | 1328 |
| 803163 | 6326 | 6345 | 124957 | 124976 | TCTACTATTCTACCTCCAGT | 57 | 1329 |
| 803164 | 6335 | 6354 | 124966 | 124985 | TTCAAACCCTCTACTATTCT | 85 | 1330 |
| 803165 | 6354 | 6373 | 124985 | 125004 | ATCAAACTCATTTGGAAACT | 71 | 1331 |
| 803166 | 6363 | 6382 | 124994 | 125013 | TTCTAATTCATCAAACTCAT | 90 | 1332 |
| 803167 | 6372 | 6391 | 125003 | 125022 | TCCTTGTATTTCTAATTCAT | 93 | 1333 |
| 803168 | 6398 | 6417 | N/A | N/A | TATTCTTTAACTGGATCAGG | 81 | 1334 |
| 803169 | 6407 | 6426 | 126523 | 126542 | GCACAACCATATTCTTTAAC | 70 | 1335 |
| 803170 | 6442 | 6461 | 126558 | 126577 | ACTGTTTAATTAATTTCTCA | 60 | 1336 |
| 803171 | 6451 | 6470 | 126567 | 126586 | CTTTCAAACACTGTTTAATT | 68 | 1337 |
| 803172 | 6460 | 6479 | 126576 | 126595 | GAGGATTTTCTTTCAAACAC | 39 | 1338 |
| 803173 | 6486 | 6505 | N/A | N/A | GACCTGGGCAGAAGTAGGCC | 62 | 1339 |
| 803174 | 6495 | 6514 | N/A | N/A | AATGTCAAAGACCTGGGCAG | 94 | 1340 |
| 803175 | 6504 | 6523 | 129649 | 129668 | TGAATTCAAAATGTCAAAGA | 113 | 1341 |
| 803176 | 6548 | 6567 | 129693 | 129712 | TTTTTAGGTAATAAAATGCG | 112 | 1342 |
| 803177 | 6577 | 6596 | 129722 | 129741 | GTGTAGCAACCATGCATTCA | 32 | 1343 |
| 803178 | 6586 | 6605 | 129731 | 129750 | TGTTGTGATGTGTAGCAACC | 54 | 162 |
| 803179 | 6595 | 6614 | 129740 | 129759 | CATTCCTGCTGTTGTGATGT | 66 | 1344 |
| 803180 | 6607 | 6626 | 129752 | 129771 | GCCAAATGCTTGCATTCCTG | 42 | 1345 |
| 803181 | 6608 | 6627 | 129753 | 129772 | AGCCAAATGCTTGCATTCCT | 38 | 1346 |
| 803182 | 6609 | 6628 | 129754 | 129773 | CAGCCAAATGCTTGCATTCC | 64 | 1347 |
| 803183 | 6610 | 6629 | 129755 | 129774 | CCAGCCAAATGCTTGCATTC | 53 | 1348 |
| 803184 | 6611 | 6630 | 129756 | 129775 | CCCAGCCAAATGCTTGCATT | 59 | 1349 |
| 803185 | 6613 | 6632 | 129758 | 129777 | AGCCCAGCCAAATGCTTGCA | 43 | 163 |
| 803186 | 6614 | 6633 | 129759 | 129778 | CAGCCCAGCCAAATGCTTGC | 73 | 1350 |
| 803187 | 6615 | 6634 | 129760 | 129779 | ACAGCCCAGCCAAATGCTTG | 97 | 1351 |
| 803188 | 6616 | 6635 | 129761 | 129780 | CACAGCCCAGCCAAATGCTT | 90 | 1352 |
| 803189 | 6617 | 6636 | 129762 | 129781 | CCACAGCCCAGCCAAATGCT | 104 | 1353 |
| 803190 | 6621 | 6640 | 129766 | 129785 | GTGCCCACAGCCCAGCCAAA | 60 | 1354 |
| 803191 | 6630 | 6649 | 129775 | 129794 | TCTGTCGGTGTGCCCACAGC | 77 | 1355 |
| 803192 | 6639 | 6658 | 129784 | 129803 | GAGCTGTCCTCTGTCGGTGT | 71 | 1356 |
| 803193 | 6665 | 6684 | 129810 | 129829 | CCTTCAGTATTTAAGTCAAG | 75 | 1357 |
| 803194 | 6674 | 6693 | 129819 | 129838 | GAAGTGTATCCTTCAGTATT | 76 | 1358 |
| 803195 | 6683 | 6702 | N/A | N/A | ACTTCCTCAGAAGTGTATCC | 89 | 1359 |
| 803196 | 6709 | 6728 | 132419 | 132438 | CTAAGCACAATATTCTACTA | 65 | 1360 |
| 803197 | 6718 | 6737 | 132428 | 132447 | GCACCAAGGCTAAGCACAAT | 54 | 1361 |
| 803198 | 6727 | 6746 | 132437 | 132456 | CAGGAAGATGCACCAAGGCT | 53 | 1362 |
| 803199 | 6753 | 6772 | 132463 | 132482 | AGACACAATCCAGCTTTCCT | 113 | 1363 |
| 803200 | 6762 | 6781 | 132472 | 132491 | CTGTGTCCCAGACACAATCC | 91 | 1364 |
| 803201 | 6771 | 6790 | 132481 | 132500 | AGTACCAGACTGTGTCCCAG | 74 | 1365 |
| 803202 | 6797 | 6816 | 132507 | 132526 | CCATCTTCGGTATTGATGAC | 57 | 1366 |
| 803203 | 6806 | 6825 | 132516 | 132535 | CTCTTTTTCCCATCTTCGGT | 61 | 1367 |
| 803204 | 6815 | 6834 | 132525 | 132544 | AGGGTATGTCTCTTTTTCCC | 42 | 1368 |
| 803205 | 6841 | 6860 | 132551 | 132570 | AAGTGACAGAATCAGTCATC | 71 | 52 |
| 803206 | 6850 | 6869 | 132560 | 132579 | AATACAAACAAGTGACAGAA | 98 | 1369 |
| 803207 | 6864 | 6883 | 132574 | 132593 | GGAAAAGGAATTGCAATACA | 76 | 1370 |
| 803208 | 6902 | 6921 | 134234 | 134253 | GTTCCAACCAAAAGAAAATT | 86 | 1371 |
| 803209 | 6911 | 6930 | 134243 | 134262 | CCATCAGCGGTTCCAACCAA | 55 | 1372 |
| 803210 | 6929 | 6948 | 134261 | 134280 | TCAAAAATTGCTAACTTGCC | 111 | 1373 |
| 803211 | 6938 | 6957 | 134270 | 134289 | GTCTTATCTTCAAAAATTGC | 92 | 1374 |
| 803212 | 6947 | 6966 | N/A | N/A | AGCTTAACAGTCTTATCTTC | 94 | 1375 |
| 803213 | 6973 | 6992 | 137377 | 137396 | GTATCTTCAAAGGAGCAGCT | 72 | 1376 |
| 803214 | 6983 | 7002 | 137387 | 137406 | CCTATATTTAGTATCTTCAA | 54 | 1377 |
| 803215 | 6992 | 7011 | 137396 | 137415 | CTGACATTTCCTATATTTAG | 73 | 1378 |
| 803216 | 7017 | 7036 | 137421 | 137440 | TTCACTCAAACACATCAATG | 68 | 1379 |
| 803217 | 7026 | 7045 | 137430 | 137449 | ATTTGTGGATTCACTCAAAC | 72 | 1380 |
| 803218 | 7035 | 7054 | 137439 | 137458 | TTCCGTTGAATTTGTGGATT | 85 | 1381 |

TABLE 17-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803219 | 7061 | 7080 | 137465 | 137484 | CCACATCCTCCCCACATTAC | 62 | 1382 |
| 803220 | 7070 | 7089 | 137474 | 137493 | ATCTTTGTGCCACATCCTCC | 77 | 1383 |
| 803221 | 7087 | 7106 | 137491 | 137510 | CATTAGAAAAGGAGAAAATC | 85 | 1384 |
| 803222 | 7105 | 7124 | 137509 | 137528 | GTTTCTGAATGGTGAAATCA | 76 | 1385 |
| 803223 | 7114 | 7133 | 137518 | 137537 | TCTCAATGAGTTTCTGAATG | 74 | 1386 |
| 803224 | 7123 | 7142 | 137527 | 137546 | TTGTTCTTGTCTCAATGAGT | 100 | 1387 |
| 803225 | 7132 | 7151 | 137536 | 137555 | ACAGTTGGCTTGTTCTTGTC | 104 | 1388 |
| 803226 | 7150 | 7169 | 141511 | 141530 | TGAAAGCTGCATAAGAAAAC | 116 | 1389 |

TABLE 18

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 25 | 235 |
| 780254 | 4111 | 4130 | 86606 | 86625 | GTTTCATTCGGTTATAAGGC | 20 | 235 |
| 803227 | 7159 | 7178 | 141520 | 141539 | TGGAATCACTGAAAGCTGCA | 65 | 1390 |
| 803228 | 7168 | 7187 | 141529 | 141548 | TTATGATGTTGGAATCACTG | 60 | 1391 |
| 803229 | 7194 | 7213 | 141555 | 141574 | ATAGAGAGCAGTGTCTACCA | 66 | 1392 |
| 803230 | 7203 | 7222 | 141564 | 141583 | CTTAGCAATATAGAGAGCAG | 97 | 1393 |
| 803231 | 7212 | 7231 | 141573 | 141592 | GCTATTTGCTTAGCAATAT | 46 | 1394 |
| 803232 | 7238 | 7257 | 141599 | 141618 | TTCTTATCCCACACTTCCAC | 89 | 1395 |
| 803233 | 7248 | 7267 | 141609 | 141628 | TTTTTCAGTTTTCTTATCCC | 75 | 1396 |
| 803234 | 7257 | 7276 | 141618 | 141637 | TCCACAGAGTTTTTCAGTTT | 64 | 1397 |
| 803235 | 7282 | 7301 | 141643 | 141662 | TTAAAAAGTGCACGCAGTCT | 108 | 1398 |
| 803236 | 7291 | 7310 | N/A | N/A | TTACCTCCCTTAAAAAGTGC | 95 | 1399 |
| 803237 | 7300 | 7319 | N/A | N/A | CTTTTACCATTACCTCCCTT | 80 | 1400 |
| 803238 | 7309 | 7328 | 142957 | 142976 | CCTTGTTTTCTTTTACCATT | 65 | 1401 |
| 803239 | 7339 | 7358 | 142987 | 143006 | TCCCAGAATAAGACATTTTG | 68 | 1402 |
| 803240 | 7348 | 7367 | 142996 | 143015 | TTTTCACTCTCCCAGAATAA | 62 | 1403 |
| 803241 | 7371 | 7390 | 143019 | 143038 | AGTGTTCTTCTGAAGGCAGA | 60 | 1404 |
| 803242 | 7380 | 7399 | 143028 | 143047 | CCAAAGAGCAGTGTTCTTCT | 86 | 1405 |
| 803243 | 7389 | 7408 | 143037 | 143056 | AGTTCCTATCCAAAGAGCAG | 87 | 1406 |
| 803244 | 7415 | 7434 | 143063 | 143082 | TCCAGGAGTAAAATATGGCC | 51 | 1407 |
| 803245 | 7424 | 7443 | 143072 | 143091 | GTTGAAAGATCCAGGAGTAA | 106 | 1408 |
| 803246 | 7433 | 7452 | 143081 | 143100 | AGTCGACGAGTTGAAAGATC | 106 | 1409 |
| 803247 | 7466 | 7485 | 143114 | 143133 | ACCGAATTACAAAAGTTGTA | 71 | 1410 |
| 803248 | 7475 | 7494 | 143123 | 143142 | ATGACTCTGACCGAATTACA | 82 | 1411 |
| 803249 | 7484 | 7503 | 143132 | 143151 | GCTGTCATCATGACTCTGAC | 65 | 1412 |
| 803250 | 7510 | 7529 | 145113 | 145132 | TGACATTTTTAAGGCTTCCT | 58 | 1413 |
| 803251 | 7522 | 7541 | 145125 | 145144 | CCAATACCAGCATGACATTT | 75 | 1414 |
| 803252 | 7531 | 7550 | 145134 | 145153 | GGTTGTAGCCCAATACCAGC | 74 | 1415 |
| 803253 | 7554 | 7573 | 145157 | 145176 | TTGTGTACCTTCAGTATTTT | 61 | 1416 |
| 803254 | 7564 | 7583 | 145167 | 145186 | CTTTCTGCTTTTGTGTACCT | 92 | 1417 |
| 803255 | 7573 | 7592 | N/A | N/A | ATTGTATCTCTTTCTGCTTT | 104 | 1418 |
| 803256 | 7598 | 7617 | 145767 | 145786 | TTGATGTCCCAAACGGTCAA | 49 | 1419 |
| 803257 | 7607 | 7626 | 145776 | 145795 | TGTGGAAGATTGATGTCCCA | 96 | 1420 |
| 803258 | 7616 | 7635 | 145785 | 145804 | TGCACTTCATGTGGAAGATT | 74 | 1421 |
| 803259 | 7625 | 7644 | 145794 | 145813 | TCTAAATTTTGCACTTCATG | 71 | 1422 |
| 803260 | 7645 | 7664 | 145814 | 145833 | TTCTCACTTCAATGTGTTTT | 48 | 1423 |
| 803261 | 7654 | 7673 | 145823 | 145842 | CTAATTCTTTTCTCACTTCA | 93 | 1424 |
| 803262 | 7666 | 7685 | 145835 | 145854 | TCATTTTTTCAGCTAATTCT | 95 | 1425 |
| 803263 | 7697 | 7716 | 145866 | 145885 | CTATTTCTCTCTTACTCAAC | 77 | 1426 |
| 803264 | 7706 | 7725 | 145875 | 145894 | AGACAATTCCTATTTCTCTC | 45 | 1427 |
| 803265 | 7717 | 7736 | 145886 | 145905 | TTCCTATCCAAAGACAATTC | 83 | 1428 |
| 803266 | 7741 | 7760 | 145910 | 145929 | TATTTACAAGAGGAGAGAAT | 75 | 1429 |
| 803267 | 7771 | 7790 | 145940 | 145959 | CCCTTTCCATGTGAACATTT | 65 | 1430 |
| 803268 | 7772 | 7791 | 145941 | 145960 | ACCCTTTCCATGTGAACATT | 49 | 1431 |
| 803269 | 7773 | 7792 | 145942 | 145961 | TACCCTTTCCATGTGAACAT | 49 | 1432 |
| 803270 | 7774 | 7793 | 145943 | 145962 | GTACCCTTTCCATGTGAACA | 41 | 1433 |
| 803271 | 7775 | 7794 | 145944 | 145963 | AGTACCCTTTCCATGTGAAC | 54 | 1434 |
| 803272 | 7777 | 7796 | 145946 | 145965 | TGAGTACCCTTTCCATGTGA | 43 | 1435 |

TABLE 18-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803273 | 7778 | 7797 | 145947 | 145966 | GTGAGTACCCTTTCCATGTG | 44 | 1436 |
| 803274 | 7779 | 7798 | 145948 | 145967 | TGTGAGTACCCTTTCCATGT | 66 | 1437 |
| 803275 | 7780 | 7799 | 145949 | 145968 | ATGTGAGTACCCTTTCCATG | 37 | 1438 |
| 803276 | 7781 | 7800 | 145950 | 145969 | AATGTGAGTACCCTTTCCAT | 57 | 1439 |
| 803277 | 7785 | 7804 | 145954 | 145973 | AAAAAATGTGAGTACCCTTT | 68 | 1440 |
| 803278 | 7794 | 7813 | 145963 | 145982 | AGCTATTTCAAAAAATGTGA | 89 | 1441 |
| 803279 | 7803 | 7822 | 145972 | 145991 | ATACACACGAGCTATTTCAA | 76 | 1442 |
| 803280 | 7812 | 7831 | 145981 | 146000 | CATTCCTTCATACACACGAG | 57 | 1443 |
| 803281 | 7850 | 7869 | 146019 | 146038 | GTAAGTATTTTACATATAT | 69 | 1444 |
| 803282 | 7876 | 7895 | 146045 | 146064 | TAGTTCTTTAAAATACACAT | 58 | 1445 |
| 803283 | 7888 | 7907 | 146057 | 146076 | TTGTGTTTTAAATAGTTCTT | 56 | 1446 |
| 803284 | 7897 | 7916 | 146066 | 146085 | AATATAACATTGTGTTTTAA | 95 | 1447 |
| 803285 | 7921 | 7940 | 146090 | 146109 | CGAAAGTAACTGGTATTTAT | 40 | 1448 |
| 803286 | 7930 | 7949 | 146099 | 146118 | ATTAATGAACGAAAGTAACT | 125 | 1449 |
| 803287 | 7939 | 7958 | 146108 | 146127 | TTTTCATTAATTAATGAACG | 99 | 1450 |
| 803288 | 7948 | 7967 | 146117 | 146136 | ACAGATTTATTTTCATTAAT | 82 | 1451 |
| 803289 | 7969 | 7988 | 146138 | 146157 | AGTACTTAAATTAGGTACTT | 126 | 1452 |
| 803290 | 7978 | 7997 | 146147 | 146166 | TTTAGTATGAGTACTTAAAT | 102 | 1453 |
| 803291 | 7987 | 8006 | 146156 | 146175 | CTTATAAATTTTAGTATGAG | 98 | 1454 |
| 803292 | 8019 | 8038 | 146188 | 146207 | CATTACAGACAAGAAAACAA | 109 | 1455 |
| 803293 | 8028 | 8047 | 146197 | 146216 | GTTTACCTCCATTACAGACA | 61 | 1456 |
| 803294 | 8037 | 8056 | 146206 | 146225 | TAAAATAAAGTTTACCTCCA | 59 | 1457 |
| 803295 | 8061 | 8080 | 146230 | 146249 | TAGTCCTGTCTTAAGCACAG | 74 | 1458 |
| 803296 | 8070 | 8089 | 146239 | 146258 | GACAAGCAATAGTCCTGTCT | 66 | 1459 |
| 803297 | 8079 | 8098 | 146248 | 146267 | AGAAAAATCGACAAGCAATA | 89 | 1460 |
| 803298 | 8105 | 8124 | 146274 | 146293 | ATTTTCATTATACCGTGCAG | 55 | 1461 |
| 803299 | 8116 | 8135 | 146285 | 146304 | ACTGTCTTAATATTTTCATT | 53 | 1462 |
| 803300 | 8125 | 8144 | 146294 | 146313 | ACATGGGAAACTGTCTTAAT | 56 | 1463 |
| 803301 | 8149 | 8168 | 146318 | 146337 | ATGCAATCTAAGAAGGAATA | 67 | 1464 |
| 803302 | 8158 | 8177 | 146327 | 146346 | TGCATTTCGATGCAATCTAA | 36 | 1465 |
| 803303 | 8167 | 8186 | 146336 | 146355 | ATATGATAGTGCATTTCGAT | 69 | 1466 |

TABLE 19

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 27 | 235 |
| 780254 | 4111 | 4130 | 86606 | 86625 | GTTTCATTCGGTTATAAGGC | 12 | 235 |
| 803304 | 8176 | 8195 | 146345 | 146364 | TACAAGCATATATGATAGTG | 83 | 1467 |
| 803305 | 8207 | 8226 | 146376 | 146395 | GACTTTATTAGTGCAAATTC | 54 | 1468 |
| 803306 | 8208 | 8227 | 146377 | 146396 | GGACTTTATTAGTGCAAATT | 45 | 1469 |
| 803307 | 8209 | 8228 | 146378 | 146397 | AGGACTTTATTAGTGCAAAT | 54 | 1470 |
| 803308 | 8210 | 8229 | 146379 | 146398 | AAGGACTTTATTAGTGCAAA | 56 | 1471 |
| 803309 | 8212 | 8231 | 146381 | 146400 | CAAAGGACTTTATTAGTGCA | 59 | 1472 |
| 803310 | 8213 | 8232 | 146382 | 146401 | ACAAAGGACTTTATTAGTGC | 58 | 1473 |
| 803311 | 8214 | 8233 | 146383 | 146402 | AACAAAGGACTTTATTAGTG | 63 | 1474 |
| 803312 | 8215 | 8234 | 146384 | 146403 | CAACAAAGGACTTTATTAGT | 101 | 1475 |
| 803313 | 8240 | 8259 | 146409 | 146428 | ACAGCAACAAAGAGAATTCA | 88 | 1476 |
| 803314 | 8252 | 8271 | 146421 | 146440 | GCACTGTTTGCAACAGCAAC | 91 | 1477 |
| 803315 | 8261 | 8280 | 146430 | 146449 | GTGTAAGATGCACTGTTTGC | 74 | 1478 |
| 803316 | 8284 | 8303 | 146453 | 146472 | TTTCTTTTGAATTGAGTGAA | 92 | 1479 |
| 803317 | 8293 | 8312 | 146462 | 146481 | TAATGGAGTTTTCTTTTGAA | 87 | 1480 |
| 803318 | 8302 | 8321 | 146471 | 146490 | TAGTACTTTTAATGGAGTTT | 115 | 1481 |
| 803319 | 8328 | 8347 | 146497 | 146516 | TTTGACAGTATGTCATGTTT | 118 | 1482 |
| 803320 | 8337 | 8356 | 146506 | 146525 | TATGAGGACTTTGACAGTAT | 101 | 1483 |
| 803321 | 8346 | 8365 | 146515 | 146534 | TTTCCTAGATATGAGGACTT | 121 | 1484 |
| 803322 | 8355 | 8374 | 146524 | 146543 | TTCTGTGTCTTTCCTAGATA | 125 | 1485 |
| 803323 | 8373 | 8392 | 146542 | 146561 | TTCTGTGACAAAGAGAGTTT | 73 | 1486 |
| 803324 | 8382 | 8401 | 146551 | 146570 | ACAGAGAGTTTCTGTGACAA | 85 | 1487 |
| 803325 | 8391 | 8410 | 146560 | 146579 | AGGAAAGACACAGAGAGTTT | 100 | 1488 |
| 803326 | 8418 | 8437 | 146587 | 146606 | GAGTTGAAAAACAACTCTAT | 129 | 1489 |

TABLE 19-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803327 | 8427 | 8446 | 146596 | 146615 | TCAAACATAGAGTTGAAAAA | 116 | 1490 |
| 803328 | 8436 | 8455 | 146605 | 146624 | TATCCACATTCAAACATAGA | 116 | 1491 |
| 803329 | 8461 | 8480 | 146630 | 146649 | TACACTAATTATACAAAATT | 114 | 1492 |
| 803330 | 8470 | 8489 | 146639 | 146658 | CACTGTATTTACACTAATTA | 73 | 1493 |
| 803331 | 8479 | 8498 | 146648 | 146667 | AGGACTGAACACTGTATTTA | 56 | 1494 |
| 803332 | 8488 | 8507 | 146657 | 146676 | ATCACTTGAAGGACTGAACA | 73 | 1495 |
| 803333 | 8524 | 8543 | 146693 | 146712 | ACAAGTAGCTAGTGGTATGA | 85 | 1496 |
| 803334 | 8533 | 8552 | 146702 | 146721 | GATTAGAAAACAAGTAGCTA | 69 | 1497 |
| 803335 | 8545 | 8564 | 146714 | 146733 | TAGAATGAAGCAGATTAGAA | 116 | 1498 |
| 803336 | 8570 | 8589 | 146739 | 146758 | TTAGGGAAAAGATGAATATA | 93 | 1499 |
| 803337 | 8579 | 8598 | 146748 | 146767 | ATCACAAATTTAGGGAAAAG | 72 | 1500 |
| 803338 | 8588 | 8607 | 146757 | 146776 | ATCTGCAGCATCACAAATTT | 77 | 1501 |
| 803339 | 8614 | 8633 | 146783 | 146802 | AAAGGTTTCTATCTGAATGA | 107 | 1502 |
| 803340 | 8639 | 8658 | 146808 | 146827 | GGAATTCTATAATTCTGAAA | 80 | 1503 |
| 803341 | 8659 | 8678 | 146828 | 146847 | ATGGTCTTGGTAGGAGCTGT | 77 | 1504 |
| 803342 | 8668 | 8687 | 146837 | 146856 | TTTATCCTCATGGTCTTGGT | 56 | 1505 |
| 803343 | 8677 | 8696 | 146846 | 146865 | TGTTAGATATTTATCCTCAT | 66 | 1506 |
| 803344 | 8705 | 8724 | 146874 | 146893 | GCTCCTTTCTCCTTCAGCAA | 58 | 1507 |
| 803345 | 8714 | 8733 | 146883 | 146902 | ATAACTAAAGCTCCTTTCTC | 111 | 1508 |
| 803346 | 8723 | 8742 | 146892 | 146911 | TTATCCATCATAACTAAAGC | 112 | 1509 |
| 803347 | 8732 | 8751 | 146901 | 146920 | CAGATATTTTTATCCATCAT | 57 | 1510 |
| 803348 | 8750 | 8769 | 146919 | 146938 | TTTGGAAGCCTAGGGTGGCA | 80 | 1511 |
| 803349 | 8759 | 8778 | 146928 | 146947 | TAAGTATAATTTGGAAGCCT | 69 | 1512 |
| 803350 | 8768 | 8787 | 146937 | 146956 | TAAACAATTTAAGTATAATT | 121 | 1513 |
| 803351 | 8794 | 8813 | 146963 | 146982 | TGATACTCCTATTGTGGTAA | 89 | 1514 |
| 803352 | 8803 | 8822 | 146972 | 146991 | ATTTGGCCCTGATACTCCTA | 71 | 1515 |
| 803353 | 8812 | 8831 | 146981 | 147000 | TACATAGGTATTTGGCCCTG | 111 | 1516 |
| 803354 | 8838 | 8857 | 147007 | 147026 | CTAAAGCAGAAATGACCTCA | 61 | 1517 |
| 803355 | 8847 | 8866 | 147016 | 147035 | GTACTTTTCCTAAAGCAGAA | 74 | 1518 |
| 803356 | 8856 | 8875 | 147025 | 147044 | TTACCGAAAGTACTTTTCCT | 89 | 1519 |
| 803357 | 8882 | 8901 | 147051 | 147070 | ATGAATACTGGTCAGGGCCA | 102 | 61 |
| 803358 | 8891 | 8910 | 147060 | 147079 | TCTGAAATAATGAATACTGG | 85 | 1520 |
| 803359 | 8900 | 8919 | 147069 | 147088 | AGGGAATTATCTGAAATAAT | 46 | 1521 |
| 803360 | 8926 | 8945 | 147095 | 147114 | ATTAAATGTACTAGTTGTCC | 90 | 1522 |
| 803361 | 8935 | 8954 | 147104 | 147123 | TCTGAGAATATTAAATGTAC | 66 | 1523 |
| 803362 | 8944 | 8963 | 147113 | 147132 | GCCATAAGTTCTGAGAATAT | 53 | 1524 |
| 803363 | 8953 | 8972 | 147122 | 147141 | TAGTAAAATGCCATAAGTTC | 79 | 1525 |
| 803364 | 8957 | 8976 | 147126 | 147145 | CACATAGTAAAATGCCATAA | 51 | 1526 |
| 803365 | 8958 | 8977 | 147127 | 147146 | TCACATAGTAAAATGCCATA | 63 | 1527 |
| 803366 | 8959 | 8978 | 147128 | 147147 | TTCACATAGTAAAATGCCAT | 43 | 1528 |
| 803367 | 8960 | 8979 | 147129 | 147148 | TTTCACATAGTAAAATGCCA | 55 | 1529 |
| 803368 | 8961 | 8980 | 147130 | 147149 | TTTTCACATAGTAAAATGCC | 80 | 1530 |
| 803369 | 8963 | 8982 | 147132 | 147151 | AGTTTTCACATAGTAAAATG | 101 | 1531 |
| 803370 | 8964 | 8983 | 147133 | 147152 | AAGTTTTCACATAGTAAAAT | 133 | 1532 |
| 803371 | 8965 | 8984 | 147134 | 147153 | AAAGTTTTCACATAGTAAAA | 77 | 1533 |
| 803372 | 8966 | 8985 | 147135 | 147154 | TAAAGTTTTCACATAGTAAA | 88 | 1534 |
| 803373 | 8967 | 8986 | 147136 | 147155 | TTAAAGTTTTCACATAGTAA | 97 | 1535 |
| 803374 | 8972 | 8991 | 147141 | 147160 | TAAATTTAAAGTTTTCACAT | 104 | 1536 |
| 803375 | 8988 | 9007 | 147157 | 147176 | TTACCCTTAATATAAATAAA | 113 | 1537 |
| 803376 | 8997 | 9016 | 147166 | 147185 | AGAATTTGATTACCCTTAAT | 82 | 1538 |
| 803377 | 9015 | 9034 | 147184 | 147203 | GAAAATCTTTCATCTTTAAG | 116 | 1539 |
| 803378 | 9028 | 9047 | 147197 | 147216 | CCTTTAAAATACAGAAAATC | 110 | 1540 |
| 803379 | 9037 | 9056 | 147206 | 147225 | GCATAGCTTCCTTTAAAATA | 70 | 1541 |
| 803380 | 9059 | 9078 | 147228 | 147247 | GTTAATTACATAACAAGTTA | 76 | 1542 |

TABLE 20

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 25 | 235 |
| 780254 | 4111 | 4130 | 86606 | 86625 | GTTTCATTCGGTTATAAGGC | 20 | 235 |

TABLE 20-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803381 | 9078 | 9097 | 147247 | 147266 | TATTATATATGATTTTTTTG | 96 | 1543 |
| 803382 | 9103 | 9122 | 147272 | 147291 | GAGATAACACTGGAACAAAG | 79 | 1544 |
| 803383 | 9112 | 9131 | 147281 | 147300 | ACAATGAAAGAGATAACACT | 96 | 1545 |
| 803384 | 9125 | 9144 | 147294 | 147313 | CAAATACAAAGTAACAATGA | 119 | 1546 |
| 803385 | 9164 | 9183 | 147333 | 147352 | GTATTCATTTTTTTAATTTG | 95 | 1547 |
| 803386 | N/A | N/A | 3733 | 3752 | TACCTGCTGCACACTCGCGA | 32 | 1548 |
| 803387 | N/A | N/A | 4361 | 4380 | ATCCAAGATACATAGCAAAT | 61 | 1549 |
| 803388 | N/A | N/A | 4768 | 4787 | TAATAGTCAGATGGAAAATA | 92 | 1550 |
| 803389 | N/A | N/A | 5023 | 5042 | TATCAAGCAGGAGTGACTCT | 81 | 1551 |
| 803390 | N/A | N/A | 5210 | 5229 | CTCTCTAGGCAGAAATACTA | 87 | 1552 |
| 803391 | N/A | N/A | 5227 | 5246 | ATACTTTGCCTCTGGTACTC | 80 | 1553 |
| 803392 | N/A | N/A | 5291 | 5310 | CAACTATGATATATCCAAAA | 139 | 1554 |
| 803393 | N/A | N/A | 7598 | 7617 | AAAAGATAGGCAGGAAAAGA | 185 | 1555 |
| 803394 | N/A | N/A | 8034 | 8053 | TGCCAAACTCATCTCTGTAC | 76 | 1556 |
| 803395 | N/A | N/A | 8402 | 8421 | GTAAACAACGGCTATTTTAG | 65 | 1557 |
| 803396 | N/A | N/A | 10211 | 10230 | CCCAGAAACAAAAGCAAGCC | 70 | 1558 |
| 803397 | N/A | N/A | 11602 | 11621 | GTACTGAAAACAAGAAGAGC | 96 | 1559 |
| 803398 | N/A | N/A | 11762 | 11781 | GGACATTTAAAGTTACAATT | 66 | 1560 |
| 803399 | N/A | N/A | 12023 | 12042 | TCTTCTTCACAACTGCATGG | 71 | 1561 |
| 803400 | N/A | N/A | 12348 | 12367 | TTTACATTATTGGAAGAAGA | 84 | 1562 |
| 803401 | N/A | N/A | 12349 | 12368 | CTTTACATTATTGGAAGAAG | 96 | 1563 |
| 803402 | N/A | N/A | 12350 | 12369 | GCTTTACATTATTGGAAGAA | 64 | 1564 |
| 803403 | N/A | N/A | 12351 | 12370 | GGCTTTACATTATTGGAAGA | 46 | 1565 |
| 803404 | N/A | N/A | 12352 | 12371 | TGGCTTTACATTATTGGAAG | 52 | 1566 |
| 803405 | N/A | N/A | 12354 | 12373 | TTTGGCTTTACATTATTGGA | 69 | 1567 |
| 803406 | N/A | N/A | 12355 | 12374 | GTTTGGCTTTACATTATTGG | 40 | 1568 |
| 803407 | N/A | N/A | 12356 | 12375 | TGTTTGGCTTTACATTATTG | 68 | 1569 |
| 803408 | N/A | N/A | 12357 | 12376 | TTGTTTGGCTTTACATTATT | 85 | 1570 |
| 803409 | N/A | N/A | 12358 | 12377 | ATTGTTTGGCTTTACATTAT | 57 | 1571 |
| 803410 | N/A | N/A | 13200 | 13219 | GAATAATTCACAATGTACAC | 64 | 1572 |
| 803411 | N/A | N/A | 13280 | 13299 | CATGTGTGTTTGTTTCTTTC | 70 | 1573 |
| 803412 | N/A | N/A | 14768 | 14787 | ATTCAAACCTTCCCAATCAC | 131 | 1574 |
| 803413 | N/A | N/A | 14988 | 15007 | TCCATCGCCAAATGGAGAAT | 102 | 1575 |
| 803414 | N/A | N/A | 15083 | 15102 | AATACTGGAATAGGAGTAGT | 98 | 1576 |
| 803415 | N/A | N/A | 15343 | 15362 | TCTCATGATCCTTAGTATGA | 72 | 1577 |
| 803416 | N/A | N/A | 15717 | 15736 | ACCTGGCCTACTCCTGTTCC | 95 | 1578 |
| 803417 | N/A | N/A | 16619 | 16638 | ATGCATATTAGTCTTTTTCC | 61 | 1579 |
| 803418 | N/A | N/A | 18995 | 19014 | CTGCCACTGTAATCACCTCT | 54 | 1580 |
| 803419 | N/A | N/A | 19777 | 19796 | TACATATTGTCTAATAATCC | 114 | 1581 |
| 803420 | N/A | N/A | 20043 | 20062 | TTTGTTGGCAGTGATGTCTC | 49 | 1582 |
| 803421 | N/A | N/A | 20233 | 20252 | TTAAAAACTTTTGATTTCTT | 131 | 1583 |
| 803422 | N/A | N/A | 20684 | 20703 | AAGGGCAACCAATGTACAAG | 43 | 1584 |
| 803423 | N/A | N/A | 20708 | 20727 | TATGACCTGTTTCCTCCATT | 60 | 1585 |
| 803424 | N/A | N/A | 20709 | 20728 | CTATGACCTGTTTCCTCCAT | 82 | 1586 |
| 803425 | V/A | N/A | 20710 | 20729 | GCTATGACCTGTTTCCTCCA | 37 | 1587 |
| 803426 | N/A | N/A | 20711 | 20730 | AGCTATGACCTGTTTCCTCC | 43 | 1588 |
| 803427 | N/A | N/A | 20712 | 20731 | CAGCTATGACCTGTTTCCTC | 35 | 1589 |
| 803428 | N/A | N/A | 20714 | 20733 | ATCAGCTATGACCTGTTTCC | 69 | 1590 |
| 803429 | N/A | N/A | 20715 | 20734 | AATCAGCTATGACCTGTTTC | 70 | 1591 |
| 803430 | N/A | N/A | 20717 | 20736 | AAAATCAGCTATGACCTGTT | 72 | 1592 |
| 803431 | N/A | N/A | 20718 | 20737 | TAAAATCAGCTATGACCTGT | 88 | 1593 |
| 803432 | N/A | N/A | 21079 | 21098 | ATGTGGTGAATATTATAGAA | 38 | 1594 |
| 803433 | N/A | N/A | 21236 | 21255 | CTTTATTGAAAATTGCCACA | 43 | 1595 |
| 803434 | N/A | N/A | 22179 | 22198 | CATTTAAGTTGGATAGTGAG | 80 | 1596 |
| 803435 | N/A | N/A | 23283 | 23302 | GGAATAAAATATACAATATA | 86 | 1597 |
| 803436 | N/A | N/A | 23734 | 23753 | AGTTCTTCTTAAAATGATCC | 34 | 1598 |
| 803437 | N/A | N/A | 24259 | 24278 | AAGCCCACATTGAAAAAACA | 80 | 1599 |
| 803438 | N/A | N/A | 24494 | 24513 | TGAAAATAAACAGAGAAGAT | 93 | 1600 |
| 803439 | N/A | N/A | 24497 | 24516 | ATGTGAAAATAAACAGAGAA | 97 | 1601 |
| 803440 | N/A | N/A | 24663 | 24682 | AGCCTAGAAGCAGTTGGTTT | 88 | 1602 |
| 803441 | N/A | N/A | 25966 | 25985 | AATAATAACAATATCCCATC | 83 | 1603 |
| 803442 | N/A | N/A | 26005 | 26024 | AAGATTGATGAACCACAGGA | 51 | 1604 |
| 803443 | N/A | N/A | 26046 | 26065 | ATTTCATCCCTTACTGCTTA | 123 | 1605 |
| 803444 | N/A | N/A | 26583 | 26602 | AGAGATAATCAAGAGAAAAA | 104 | 1606 |
| 803445 | N/A | N/A | 27062 | 27081 | AGTATGGAGCTCCTTTACCA | 66 | 1607 |
| 803446 | N/A | N/A | 28223 | 28242 | TACATTGAGATGTGTATATT | 111 | 1608 |
| 803447 | N/A | N/A | 29215 | 29234 | TGCTTAGGAGAAGCCTTGG | 62 | 1609 |
| 803448 | N/A | N/A | 29216 | 29235 | GTGCTTAGGAGAAGCCTTG | 41 | 1610 |
| 803449 | N/A | N/A | 29217 | 29236 | TGTGCTTTAGGAGAAGCCTT | 36 | 1611 |
| 803450 | N/A | N/A | 29218 | 29237 | GTGTGCTTTAGGAGAAGCCT | 34 | 1612 |
| 803451 | N/A | N/A | 29219 | 29238 | GGTGTGCTTTAGGAGAAGCC | 40 | 1613 |

TABLE 20-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803452 | N/A | N/A | 29221 | 29240 | GAGGTGTGCTTTAGGAGAAG | 58 | 1614 |
| 803453 | N/A | N/A | 29222 | 29241 | TGAGGTGTGCTTTAGGAGAA | 56 | 1615 |
| 803454 | N/A | N/A | 29223 | 29242 | ATGAGGTGTGCTTTAGGAGA | 80 | 1616 |
| 803455 | N/A | N/A | 29224 | 29243 | AATGAGGTGTGCTTTAGGAG | 68 | 1617 |
| 803456 | N/A | N/A | 29225 | 29244 | GAATGAGGTGTGCTTTAGGA | 63 | 1618 |
| 803457 | N/A | N/A | 29927 | 29946 | ATTTTAAAACGATCAGCCAG | 87 | 1619 |

TABLE 21

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 16 | 235 |
| 780254 | 4111 | 4130 | 86606 | 86625 | GTTTCATTCGGTTATAAGGC | 28 | 235 |
| 803458 | N/A | N/A | 30062 | 30081 | AGTTGGGAACTCATCATAGG | 79 | 1620 |
| 803459 | N/A | N/A | 30238 | 30257 | AGGCTCACGGATATGAAACA | 59 | 1621 |
| 803460 | N/A | N/A | 30698 | 30717 | AAGAGAGGAAAAACTGAAAA | 83 | 1622 |
| 803461 | N/A | N/A | 31335 | 31354 | GTTTACACATAGAAGTCCGG | 46 | 1623 |
| 803462 | N/A | N/A | 32129 | 32148 | TAAAGGGATACAAGCCATTT | 74 | 1624 |
| 803463 | N/A | N/A | 32534 | 32553 | TCCTTGAGAGCAGCCCCTGT | 76 | 1625 |
| 803464 | N/A | N/A | 32577 | 32596 | ATTCGAGAACAGCGATTCCC | 100 | 1626 |
| 803465 | N/A | N/A | 32857 | 32876 | ACTGAACAAAGACATCAGGG | 36 | 1627 |
| 803466 | N/A | N/A | 32987 | 33006 | ATGAACGAGCTACTCAAGTT | 79 | 1628 |
| 803467 | N/A | N/A | 32997 | 33016 | AAGAAAGTTGATGAACGAGC | 48 | 1629 |
| 803468 | N/A | N/A | 33091 | 33110 | CCTGCCAATGTAGCCATTTT | 40 | 1630 |
| 803469 | N/A | N/A | 33163 | 33182 | GAATAGGAAAAATGTCACAC | 39 | 1631 |
| 803470 | N/A | N/A | 33422 | 33441 | GTCTTACTCAATAGTCACCT | 25 | 1632 |
| 803471 | N/A | N/A | 33499 | 33518 | TCTTGATCTCATCCACTCCA | 44 | 1633 |
| 803472 | N/A | N/A | 35580 | 35599 | CAAGTGTCTTATGTTTTTCT | 42 | 1634 |
| 803473 | N/A | N/A | 35803 | 35822 | GATTTTATCTTTTATAACTT | 75 | 1635 |
| 803474 | N/A | N/A | 36736 | 36755 | TCTGTTTACTTATCAGTCTC | 77 | 1636 |
| 803475 | N/A | N/A | 37002 | 37021 | GCAGTAGGTACTATGAACTT | 36 | 1637 |
| 803476 | N/A | N/A | 38011 | 38030 | CTTGAACTCAGGTCATGGCA | 69 | 1638 |
| 803477 | N/A | N/A | 38572 | 38591 | CTCACCCCGACCATGTGCA | 71 | 1639 |
| 803478 | N/A | N/A | 38768 | 38787 | CACAATGCTATTGTCTTTAG | 72 | 1640 |
| 803479 | N/A | N/A | 39901 | 39920 | CATAATGTACATCTTTGCCA | 59 | 1641 |
| 803480 | N/A | N/A | 40030 | 40049 | AATGTCTATATAACAAGTTA | 80 | 1642 |
| 803481 | N/A | N/A | 40156 | 40175 | TATATCCCTTCTTAAAGAAT | 94 | 1643 |
| 803482 | N/A | N/A | 40684 | 40703 | CGTGTGGACTGTAAATTTTT | 91 | 1644 |
| 803483 | N/A | N/A | 40840 | 40859 | CATCATGCTACATGTAATGG | 59 | 1645 |
| 803484 | N/A | N/A | 41078 | 41097 | TGCTGGGAATACTATGGTAA | 64 | 1646 |
| 803485 | N/A | N/A | 41108 | 41127 | ATTCCAATTACATGCCAAGG | 49 | 1647 |
| 803486 | N/A | N/A | 41173 | 41192 | ATCTGCATTAATGCAAACTG | 71 | 1648 |
| 803487 | N/A | N/A | 41893 | 41912 | ATTCTTCTGGCATGCCTAAA | 75 | 1649 |
| 803488 | N/A | N/A | 42134 | 42153 | TCATCTTATGTCTCTAACCA | 68 | 1650 |
| 803489 | N/A | N/A | 44968 | 44987 | TACTTTGCTGAGTACCATCC | 54 | 1651 |
| 803490 | N/A | N/A | 45375 | 45394 | AGGAAGTAACCATGTCCTCA | 38 | 1652 |
| 803491 | N/A | N/A | 45376 | 45395 | AAGGAAGTAACCATGTCCTC | 58 | 1653 |
| 803492 | N/A | N/A | 45377 | 45396 | AAAGGAAGTAACCATGTCCT | 57 | 1654 |
| 803493 | N/A | N/A | 45378 | 45397 | AAAAGGAAGTAACCATGTCC | 93 | 1655 |
| 803494 | N/A | N/A | 45379 | 45398 | TAAAAGGAAGTAACCATGTC | 92 | 1656 |
| 803495 | N/A | N/A | 45381 | 45400 | ATTAAAAGGAAGTAACCATG | 78 | 1657 |
| 803496 | N/A | N/A | 45382 | 45401 | TATTAAAAGGAAGTAACCAT | 90 | 1658 |
| 803497 | N/A | N/A | 45383 | 45402 | GTATTAAAAGGAAGTAACCA | 86 | 1659 |
| 803498 | N/A | N/A | 45384 | 45403 | GGTATTAAAAGGAAGTAACC | 34 | 1660 |
| 803499 | N/A | N/A | 45385 | 45404 | AGGTATTAAAAGGAAGTAAC | 50 | 1661 |
| 803500 | N/A | N/A | 46126 | 46145 | TATGTATCCAAACATGGATT | 71 | 1662 |
| 803501 | N/A | N/A | 46232 | 46251 | GGTGACAAAGTCTTCATCTG | 58 | 1663 |
| 803502 | N/A | N/A | 46931 | 46950 | TTTATTTGAGTCTATTTCCT | 79 | 1664 |
| 803503 | N/A | N/A | 48097 | 48116 | GGGTGCATAGTCTGTAGGTA | 32 | 1665 |
| 803504 | N/A | N/A | 48768 | 48787 | GGATTTCAAGAGAAAAAATC | 93 | 1666 |
| 803505 | N/A | N/A | 48918 | 48937 | ATATCTTTACCATGTATATG | 88 | 1667 |

TABLE 21-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803506 | N/A | N/A | 49003 | 49022 | TCCAAACTCAGAATGCACCA | 42 | 1668 |
| 803507 | N/A | N/A | 49316 | 49335 | GTCTATGAGTAATGGCATGG | 47 | 1669 |
| 803508 | N/A | N/A | 49674 | 49693 | GGATTAAAATCAATTTATCA | 80 | 1670 |
| 803509 | N/A | N/A | 50436 | 50455 | AATTTCTTTTGGCTTGATAC | 89 | 1671 |
| 803510 | N/A | N/A | 51368 | 51387 | TTCAAATTATGCGAATCTGA | 66 | 1672 |
| 803511 | N/A | N/A | 51478 | 51497 | TTGGACATCATTTCATTTAT | 48 | 1673 |
| 803512 | N/A | N/A | 52070 | 52089 | ACCTTAAAAGCCCAGGATCT | 85 | 1674 |
| 803513 | N/A | N/A | 52149 | 52168 | ACTTTAAAGATGCAGAAATA | 80 | 1675 |
| 803514 | N/A | N/A | 52150 | 52169 | AACTTTAAAGATGCAGAAAT | 92 | 1676 |
| 803515 | N/A | N/A | 52151 | 52170 | AAACTTTAAAGATGCAGAAA | 111 | 1677 |
| 803516 | N/A | N/A | 52152 | 52171 | CAAACTTTAAAGATGCAGAA | 63 | 1678 |
| 803517 | N/A | N/A | 52153 | 52172 | CCAAACTTTAAAGATGCAGA | 28 | 1679 |
| 803518 | N/A | N/A | 52155 | 52174 | TGCCAAACTTTAAAGATGCA | 40 | 1680 |
| 803519 | N/A | N/A | 52156 | 52175 | TTGCCAAACTTTAAAGATGC | 30 | 1681 |
| 803520 | N/A | N/A | 52157 | 52176 | TTTGCCAAACTTTAAAGATG | 63 | 1682 |
| 803521 | N/A | N/A | 52158 | 52177 | GTTTGCCAAACTTTAAAGAT | 50 | 1683 |
| 803522 | N/A | N/A | 52159 | 52178 | GGTTTGCCAAACTTTAAAGA | 39 | 1684 |
| 803523 | N/A | N/A | 52305 | 52324 | CCAAATATGTTTCACCCCAG | 78 | 1685 |
| 803524 | N/A | N/A | 52501 | 52520 | AGCATTTTACAATTAAGGA | 59 | 1686 |
| 803525 | N/A | N/A | 53088 | 53107 | CATACTTTAGTCTGTATTTC | 69 | 1687 |
| 803526 | N/A | N/A | 53538 | 53557 | TTATTATATATCATGTTTTA | 83 | 1688 |
| 803527 | N/A | N/A | 53539 | 53558 | GTTATTATATATCATGTTTT | 62 | 1689 |
| 803528 | N/A | N/A | 53540 | 53559 | AGTTATTATATATCATGTTT | 55 | 1690 |
| 803529 | N/A | N/A | 53541 | 53560 | CAGTTATTATATATCATGTT | 55 | 1691 |
| 803530 | N/A | N/A | 53542 | 53561 | ACAGTTATTATATATCATGT | 33 | 1692 |
| 803531 | N/A | N/A | 53544 | 53563 | AGACAGTTATTATATATCAT | 49 | 1693 |
| 803532 | N/A | N/A | 53545 | 53564 | AAGACAGTTATTATATATCA | 64 | 1694 |
| 803533 | N/A | N/A | 53546 | 53565 | AAAGACAGTTATTATATATC | 80 | 1695 |
| 803534 | N/A | N/A | 53547 | 53566 | CAAAGACAGTTATTATATAT | 100 | 1696 |

TABLE 22

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 20 | 235 |
| 780254 | 4111 | 4130 | 86606 | 86625 | GTTTCATTCGGTTATAAGGC | 19 | 235 |
| 803535 | N/A | N/A | 53548 | 53567 | ACAAAGACAGTTATTATATA | 107 | 1697 |
| 803536 | N/A | N/A | 54011 | 54030 | TTCCTGAGTCAGCTGGGCAC | 74 | 1698 |
| 803537 | N/A | N/A | 55467 | 55486 | GTTGAGTGTAGTTGAGAAGC | 49 | 1699 |
| 803538 | N/A | N/A | 55699 | 55718 | AAAGATGCTTGTCTAAAGCC | 51 | 1700 |
| 803539 | N/A | N/A | 55823 | 55842 | AATAAATACTCCCTCTCTCT | 89 | 1701 |
| 803540 | N/A | N/A | 56181 | 56200 | ACTAAAAAGAGTGGAAATGA | 98 | 1702 |
| 803541 | N/A | N/A | 57300 | 57319 | GGCAAACATAGTACTTTATT | 27 | 1703 |
| 803542 | N/A | N/A | 57536 | 57555 | TGTTGCTTGCTTAAAAGAAA | 87 | 1704 |
| 803543 | N/A | N/A | 59667 | 59686 | TACTGCTCACAGATATTTAT | 82 | 1705 |
| 803544 | N/A | N/A | 59986 | 60005 | CTCTTGTCAATGCCCTACAC | 64 | 1706 |
| 803545 | N/A | N/A | 60613 | 60632 | GCAAAAGGTGTTCATTCTT | 71 | 1707 |
| 803546 | N/A | N/A | 60625 | 60644 | ACTTTTCACCCAGCAAAAAG | 106 | 1708 |
| 803547 | N/A | N/A | 60658 | 60677 | ATGCTATTTCTATTACCCCA | 58 | 1709 |
| 803548 | N/A | N/A | 61404 | 61423 | ACCTTCCTCTAAATGTTATG | 87 | 1710 |
| 803549 | N/A | N/A | 61573 | 61592 | CTGTCCTGCCTTTATTTGTG | 86 | 1711 |
| 803550 | N/A | N/A | 62233 | 62252 | TGTTACTTACTTGTTTGTTT | 108 | 1712 |
| 803551 | N/A | N/A | 63413 | 63432 | TTGACTTCATGGTACTAACA | 76 | 1713 |
| 803552 | N/A | N/A | 63832 | 63851 | CAAAGCATTCCACAACATGT | 65 | 1714 |
| 803553 | N/A | N/A | 63953 | 63972 | TGCATTTTCATCAACATTAG | 59 | 1715 |
| 803554 | N/A | N/A | 64097 | 64116 | TTTTTGGCATAAGACTAGTT | 79 | 1716 |
| 803555 | N/A | N/A | 64246 | 64265 | TCTATGTTTTTTTAACTGGG | 40 | 1717 |
| 803556 | N/A | N/A | 64593 | 64612 | CAACAGTAGGAATAGCAATA | 98 | 1718 |
| 803557 | N/A | N/A | 64954 | 64973 | GTTTGCTGAGTGATTCATTA | 59 | 1719 |
| 803558 | N/A | N/A | 66316 | 66335 | AATGGTTTGACTTGAGACAC | 52 | 1720 |
| 803559 | N/A | N/A | 66412 | 66431 | AATTTTCAAAGCGCATGAAA | 92 | 1721 |

TABLE 22-continued

Percent control of human LRRK2 RNA with 5-10-5 MOE gapmers
with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803560 | N/A | N/A | 66414 | 66433 | TTAATTTTCAAAGCGCATGA | 45 | 1722 |
| 803561 | N/A | N/A | 66415 | 66434 | GTTAATTTTCAAAGCGCATG | 29 | 1723 |
| 803562 | N/A | N/A | 66416 | 66435 | TGTTAATTTTCAAAGCGCAT | 29 | 1724 |
| 803563 | N/A | N/A | 66418 | 66437 | TATGTTAATTTTCAAAGCGC | 32 | 1725 |
| 803564 | N/A | N/A | 66419 | 66438 | ATATGTTAATTTTCAAAGCG | 96 | 1726 |
| 803565 | N/A | N/A | 66420 | 66439 | AATATGTTAATTTTCAAAGC | 90 | 1727 |
| 803566 | N/A | N/A | 66421 | 66440 | GAATATGTTAATTTTCAAAG | 100 | 1728 |
| 803567 | N/A | N/A | 66422 | 66441 | TGAATATGTTAATTTTCAAA | 112 | 1729 |
| 803568 | N/A | N/A | 66672 | 66691 | AGAATGCTCATGTACTGCTG | 43 | 1730 |
| 803569 | N/A | N/A | 66673 | 66692 | CAGAATGCTCATGTACTGCT | 55 | 1731 |
| 803570 | N/A | N/A | 66911 | 66930 | CTGTCACAACTTCTATCTAG | 69 | 1732 |
| 803571 | N/A | N/A | 67066 | 67085 | GTTTCTTAAGTGGGATACAA | 25 | 1733 |
| 803572 | N/A | N/A | 67163 | 67182 | ACTTAAAATGTTTTAGACCT | 88 | 1734 |
| 803573 | N/A | N/A | 68270 | 68289 | AATACCTCAGCAGATGCTGA | 81 | 1735 |
| 803574 | N/A | N/A | 68715 | 68734 | CACATTACTAAAACTGACTT | 78 | 1736 |
| 803575 | N/A | N/A | 68989 | 69008 | AAACCAGTGTTCTAAGCTTC | 64 | 1737 |
| 803576 | N/A | N/A | 70079 | 70098 | AAATGATACTAACTGCAAAC | 85 | 1738 |
| 803577 | N/A | N/A | 70083 | 70102 | AAGAAAATGATACTAACTGC | 78 | 1739 |
| 803578 | N/A | N/A | 70146 | 70165 | TAATCTGCATATGGGTTTCT | 36 | 1740 |
| 803579 | N/A | N/A | 70615 | 70634 | AGATTATTAAATTATCATAA | 112 | 1741 |
| 803580 | N/A | N/A | 71056 | 71075 | TATTTGAATTTCATGTTTCA | 54 | 1742 |
| 803581 | N/A | N/A | 71205 | 71224 | TTTTTATGGAGACCGCTGGA | 77 | 1743 |
| 803582 | N/A | N/A | 71512 | 71531 | GTCCATTCCCTTTGTAAAAT | 53 | 1744 |
| 803583 | N/A | N/A | 71525 | 71544 | TGGAAATTTCACAGTCCATT | 30 | 1745 |
| 803584 | N/A | N/A | 72654 | 72673 | TCATTAACCAAACTACTTTT | 106 | 1746 |
| 803585 | N/A | N/A | 72790 | 72809 | ATTATGAGGATAAAAGAAAA | 125 | 1747 |
| 803586 | N/A | N/A | 72791 | 72810 | AATTATGAGGATAAAAGAAA | 121 | 1748 |
| 803587 | N/A | N/A | 72792 | 72811 | CAATTATGAGGATAAAAGAA | 117 | 1749 |
| 803588 | N/A | N/A | 72793 | 72812 | CCAATTATGAGGATAAAAGA | 92 | 1750 |
| 803589 | N/A | N/A | 72794 | 72813 | CCCAATTATGAGGATAAAAG | 49 | 1751 |
| 803590 | N/A | N/A | 72796 | 72815 | AACCCAATTATGAGGATAAA | 81 | 1752 |
| 803591 | N/A | N/A | 72797 | 72816 | GAACCCAATTATGAGGATAA | 60 | 1753 |
| 803592 | N/A | N/A | 72798 | 72817 | AGAACCCAATTATGAGGATA | 85 | 1754 |
| 803593 | N/A | N/A | 72799 | 72818 | AAGAACCCAATTATGAGGAT | 99 | 1755 |
| 803594 | N/A | N/A | 72800 | 72819 | TAAGAACCCAATTATGAGGA | 89 | 1756 |
| 803595 | N/A | N/A | 73940 | 73959 | AGATCTGTTTCCATTGCCTG | 24 | 1757 |
| 803596 | N/A | N/A | 74241 | 74260 | CTTTAAGTTACACATTATTT | 44 | 1758 |
| 803597 | N/A | N/A | 74300 | 74319 | CAAACTATGTTATACTTTAA | 92 | 1759 |
| 803598 | N/A | N/A | 76344 | 76363 | ACTCTTCAGAGTCTGAAAAG | 79 | 1760 |
| 803599 | N/A | N/A | 76345 | 76364 | AACTCTTCAGAGTCTGAAAA | 71 | 1761 |
| 803600 | N/A | N/A | 76346 | 76365 | AAACTCTTCAGAGTCTGAAA | 71 | 1762 |
| 803601 | N/A | N/A | 76347 | 76366 | CAAACTCTTCAGAGTCTGAA | 67 | 1763 |
| 803602 | N/A | N/A | 76348 | 76367 | TCAAACTCTTCAGAGTCTGA | 62 | 1764 |
| 803603 | N/A | N/A | 76350 | 76369 | TGTCAAACTCTTCAGAGTCT | 20 | 1765 |
| 803604 | N/A | N/A | 76351 | 76370 | GTGTCAAACTCTTCAGAGTC | 16 | 1766 |
| 803605 | N/A | N/A | 77606 | 77625 | ATAGTTGGGAACGAATAGTA | 61 | 1767 |
| 803606 | N/A | N/A | 77607 | 77626 | TATAGTTGGGAACGAATAGT | 89 | 1768 |
| 803607 | N/A | N/A | 77608 | 77627 | TTATAGTTGGGAACGAATAG | 94 | 1769 |
| 803608 | N/A | N/A | 77609 | 77628 | CTTATAGTTGGGAACGAATA | 72 | 1770 |
| 803609 | N/A | N/A | 77610 | 77629 | TCTTATAGTTGGGAACGAAT | 65 | 1771 |
| 803610 | N/A | N/A | 77612 | 77631 | TGTCTTATAGTTGGGAACGA | 36 | 1772 |
| 803611 | N/A | N/A | 77613 | 77632 | ATGTCTTATAGTTGGGAACG | 32 | 1773 |

TABLE 23

Percent control of human LRRK2 RNA with 5-10-5 MOE gapmers
with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 12 | 235 |
| 780254 | 4111 | 4130 | 86606 | 86625 | GTTTCATTCGGTTATAAGGC | 11 | 235 |
| 780617 | N/A | N/A | 81581 87838 | 81600 87857 | GTTTGAAGGAATAGCTGACA | 35 | 667 |

TABLE 23-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780618 | N/A | N/A | 81584 87841 | 81603 87860 | AGTGTTTGAAGGAATAGCTG | 25 | 668 |
| 780619 | N/A | N/A | 81587 87844 | 81606 87863 | CATAGTGTTTGAAGGAATAG | 62 | 669 |
| 780620 | N/A | N/A | 81590 87847 | 81609 87866 | AGCCATAGTGTTTGAAGGAA | 11 | 670 |
| 780621 | N/A | N/A | 81593 87850 | 81612 87869 | AAAAGCCATAGTGTTTGAAG | 55 | 671 |
| 780622 | N/A | N/A | 81596 87853 | 81615 87872 | CTAAAAAGCCATAGTGTTTG | 69 | 672 |
| 780623 | N/A | N/A | 81599 87856 | 81618 87875 | ATTCTAAAAAGCCATAGTGT | 45 | 673 |
| 780624 | N/A | N/A | 81630 87887 | 81649 87906 | GCAGCATCATGCAAGCAGCA | 12 | 674 |
| 780625 | N/A | N/A | 81633 87890 | 81652 87909 | ATTGCAGCATCATGCAAGCA | 40 | 675 |
| 803612 | N/A | N/A | 77614 | 77633 | AATGTCTTATAGTTGGGAAC | 36 | 1774 |
| 803613 | N/A | N/A | 77615 | 77634 | GAATGTCTTATAGTTGGGAA | 45 | 1775 |
| 803614 | N/A | N/A | 77616 | 77635 | AGAATGTCTTATAGTTGGGA | 30 | 1776 |
| 803615 | N/A | N/A | 78807 | 78826 | TAAGGACAGAGACCGAGTTT | 58 | 1777 |
| 803616 | N/A | N/A | 79332 | 79351 | CATTTACATGGGATTATTTT | 56 | 1778 |
| 803617 | N/A | N/A | 79675 | 79694 | ATAGCTATTATACCTCACCT | 52 | 1779 |
| 803618 | N/A | N/A | 79976 | 79995 | ATTGTTAAGAAGGAAATGCA | 70 | 1780 |
| 803619 | N/A | N/A | 80327 | 80346 | ACTCTGGTATATTTTATGAT | N/A | 1781 |
| 803620 | N/A | N/A | 80378 | 80397 | AGAGATTGGGAAACATTCAG | 38 | 1782 |
| 803621 | N/A | N/A | 80523 | 80542 | TATAGCAAAACAACTATGAA | 84 | 1783 |
| 803622 | N/A | N/A | 81353 | 81372 | CCCCAAAATTTCACTCAAAC | 55 | 1784 |
| 803623 | N/A | N/A | 81582 87839 | 81601 87858 | TGTTTGAAGGAATAGCTGAC | 50 | 1785 |
| 803624 | N/A | N/A | 81583 87840 | 81602 87859 | GTGTTTGAAGGAATAGCTGA | 39 | 1786 |
| 803625 | N/A | N/A | 81585 87842 | 81604 87861 | TAGTGTTTGAAGGAATAGCT | 48 | 1787 |
| 803626 | N/A | N/A | 81586 87843 | 81605 87862 | ATAGTGTTTGAAGGAATAGC | 48 | 1788 |
| 803627 | N/A | N/A | 81588 87845 | 81607 87864 | CCATAGTGTTTGAAGGAATA | 26 | 1789 |
| 803628 | N/A | N/A | 81589 87846 | 81608 87865 | GCCATAGTGTTTGAAGGAAT | 12 | 1790 |
| 803629 | N/A | N/A | 81591 87848 | 81610 87867 | AAGCCATAGTGTTTGAAGGA | 19 | 1791 |
| 803630 | N/A | N/A | 81592 87849 | 81611 87868 | AAAGCCATAGTGTTTGAAGG | 34 | 1792 |
| 803631 | N/A | N/A | 81594 87851 | 81613 87870 | AAAAAGCCATAGTGTTTGAA | 56 | 1793 |
| 803632 | N/A | N/A | 81595 87852 | 81614 87871 | TAAAAGCCATAGTGTTTGA | 76 | 1794 |
| 803633 | N/A | N/A | 81597 87854 | 81616 87873 | TCTAAAAAGCCATAGTGTTT | 58 | 1795 |
| 803634 | N/A | N/A | 81598 87855 | 81617 87874 | TTCTAAAAAGCCATAGTGTT | 71 | 1796 |
| 803635 | N/A | N/A | 81625 | 81644 | ATCATGCAAGCAGCATTTTA | 63 | 1797 |
| 803636 | N/A | N/A | 81626 | 81645 | CATCATGCAAGCAGCATTTT | 82 | 1798 |
| 803637 | N/A | N/A | 81627 | 81646 | GCATCATGCAAGCAGCATTT | 23 | 1799 |
| 803638 | N/A | N/A | 81628 | 81647 | AGCATCATGCAAGCAGCATT | 25 | 1800 |
| 803639 | N/A | N/A | 81629 | 81648 | CAGCATCATGCAAGCAGCAT | 34 | 1801 |
| 803640 | N/A | N/A | 81631 87888 | 81650 87907 | TGCAGCATCATGCAAGCAGC | 16 | 1802 |
| 803641 | N/A | N/A | 81632 87889 | 81651 87908 | TTGCAGCATCATGCAAGCAG | 31 | 1803 |
| 803642 | N/A | N/A | 81634 87891 | 81653 87910 | CATTGCAGCATCATGCAAGC | 44 | 1804 |
| 803643 | N/A | N/A | 81635 87892 | 81654 87911 | TCATTGCAGCATCATGCAAG | 43 | 1805 |
| 803644 | N/A | N/A | 81822 | 81841 | GGAGATAATAACAGTGGCTA | 48 | 1806 |
| 803645 | N/A | N/A | 82500 | 82519 | GTGGAAGTATTAAGGCTACT | 14 | 1807 |
| 803646 | N/A | N/A | 82501 | 82520 | AGTGGAAGTATTAAGGCTAC | 23 | 1808 |
| 803647 | N/A | N/A | 82502 | 82521 | TAGTGGAAGTATTAAGGCTA | 20 | 1809 |
| 803648 | N/A | N/A | 82503 | 82522 | TTAGTGGAAGTATTAAGGCT | 36 | 1810 |
| 803649 | N/A | N/A | 82504 | 82523 | TTTAGTGGAAGTATTAAGGC | 43 | 1811 |
| 803650 | N/A | N/A | 82506 | 82525 | TGTTTAGTGGAAGTATTAAG | 32 | 1812 |

TABLE 23-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803651 | N/A | N/A | 82507 | 82526 | TTGTTTAGTGGAAGTATTAA | 81 | 1813 |
| 803652 | N/A | N/A | 82508 | 82527 | ATTGTTTAGTGGAAGTATTA | 60 | 1814 |
| 803653 | N/A | N/A | 82509 | 82528 | TATTGTTTAGTGGAAGTATT | 62 | 1815 |
| 803654 | N/A | N/A | 82510 | 82529 | TTATTGTTTAGTGGAAGTAT | 36 | 1816 |
| 803655 | N/A | N/A | 82697 | 82716 | TTGTCATAGTTAAGTAACAG | 20 | 1817 |
| 803656 | N/A | N/A | 83102 | 83121 | AAACAAGTAATACAGTATAC | 83 | 1818 |
| 803657 | N/A | N/A | 83213 | 83232 | ATTTCAGATTTACAACAGAG | 70 | 1819 |
| 803658 | N/A | N/A | 85777 | 85796 | TGTTAAAGCTTGATAATAGG | 49 | 1820 |
| 803659 | N/A | N/A | 86988 | 87007 | AGCACCAAATTGTTCCTAAC | 62 | 1821 |
| 803660 | N/A | N/A | 89783 | 89802 | AGCACACATAATCTATATAA | 34 | 1822 |
| 803661 | N/A | N/A | 89916 | 89935 | TACCATCTATCATCAATAAA | 26 | 1823 |
| 803662 | N/A | N/A | 90146 | 90165 | TTCTCTGACAACAATGACAA | 62 | 1824 |
| 803663 | N/A | N/A | 90678 | 90697 | TGTCTGCACAGACACCTGTT | 87 | 1825 |
| 803664 | N/A | N/A | 91038 | 91057 | GTATCTCTTAACCCAGAGAA | 37 | 1826 |
| 803665 | N/A | N/A | 91039 | 91058 | TGTATCTCTTAACCCAGAGA | 17 | 1827 |
| 803666 | N/A | N/A | 91040 | 91059 | ATGTATCTCTTAACCCAGAG | 24 | 1828 |
| 803667 | N/A | N/A | 91041 | 91060 | CATGTATCTCTTAACCCAGA | 36 | 1829 |
| 803668 | N/A | N/A | 91042 | 91061 | TCATGTATCTCTTAACCCAG | 37 | 1830 |
| 803669 | N/A | N/A | 91044 | 91063 | TTTCATGTATCTCTTAACCC | 26 | 1831 |
| 803670 | N/A | N/A | 91045 | 91064 | TTTTCATGTATCTCTTAACC | 58 | 1832 |
| 803671 | N/A | N/A | 91046 | 91065 | GTTTTCATGTATCTCTTAAC | 20 | 1833 |
| 803672 | N/A | N/A | 91047 | 91066 | TGTTTTCATGTATCTCTTAA | 36 | 1834 |
| 803673 | N/A | N/A | 91048 | 91067 | CTGTTTTCATGTATCTCTTA | 21 | 1835 |
| 803674 | N/A | N/A | 91144 | 91163 | AAATTAACTTGGTCTTTTTC | 68 | 1836 |
| 803675 | N/A | N/A | 91456 | 91475 | TCTGTTGCTCTTAGAATCTA | 23 | 1837 |
| 803676 | N/A | N/A | 91530 | 91549 | ATGGAACCTTGAACTTGGGA | 25 | 1838 |
| 803677 | N/A | N/A | 92329 | 92348 | GATTCAGAAACACTTTTATA | 59 | 1839 |
| 803678 | N/A | N/A | 92773 | 92792 | AAGTTGCTTTGAGAATTTTC | 48 | 1840 |
| 803679 | N/A | N/A | 93235 | 93254 | AAATCTAGTCCAACTTCCTC | 78 | 1841 |

TABLE 24

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 18 | 235 |
| 780254 | 4111 | 4130 | 86606 | 86625 | GTTTCATTCGGTTATAAGGC | 20 | 235 |
| 803680 | N/A | N/A | 93932 | 93951 | ACTCATTGGTAATGGATTAT | 24 | 1842 |
| 803681 | N/A | N/A | 94454 | 94473 | TTGCAATGTTTCAATATGCT | 53 | 1843 |
| 803682 | N/A | N/A | 94455 | 94474 | ATTGCAATGTTTCAATATGC | 26 | 1844 |
| 803683 | N/A | N/A | 94456 | 94475 | GATTGCAATGTTTCAATATG | 58 | 1845 |
| 803684 | N/A | N/A | 94457 | 94476 | TGATTGCAATGTTTCAATAT | 65 | 1846 |
| 803685 | N/A | N/A | 94458 | 94477 | CTGATTGCAATGTTTCAATA | 53 | 1847 |
| 803686 | N/A | N/A | 94460 | 94479 | TGCTGATTGCAATGTTTCAA | 24 | 1848 |
| 803687 | N/A | N/A | 94461 | 94480 | TTGCTGATTGCAATGTTTCA | 57 | 1849 |
| 803688 | N/A | N/A | 94462 | 94481 | ATTGCTGATTGCAATGTTTC | 59 | 1850 |
| 803689 | N/A | N/A | 94463 | 94482 | AATTGCTGATTGCAATGTTT | 54 | 1851 |
| 803690 | N/A | N/A | 94464 | 94483 | TAATTGCTGATTGCAATGTT | 75 | 1852 |
| 803691 | N/A | N/A | 95362 | 95381 | AATCGGAAATTTAAATTATC | 104 | 1853 |
| 803692 | N/A | N/A | 95619 | 95638 | TTAGTGACCTAACAGCTCGG | 64 | 1854 |
| 803693 | N/A | N/A | 97048 | 97067 | GTACAGTATTTATTGAATCA | 27 | 1855 |
| 803694 | N/A | N/A | 97142 | 97161 | ATTTATGCTATCATGTAGTT | 71 | 1856 |
| 803695 | N/A | N/A | 97748 | 97767 | AATAATATATTCCCAGGAAA | 90 | 1857 |
| 803696 | N/A | N/A | 97935 | 97954 | TAGCAACCATGTGGCCTAGA | 59 | 1858 |
| 803697 | N/A | N/A | 98088 | 98107 | ACTGTCAAAATCTGAAAGAT | 92 | 1859 |
| 803698 | N/A | N/A | 98337 | 98356 | AGTTAGTTTGACAATTAAAA | 72 | 1860 |
| 803699 | N/A | N/A | 98486 | 98505 | AGTAACTATACACATAAAGT | 99 | 1861 |
| 803700 | N/A | N/A | 99619 | 99638 | CACCGGATTTGCTCTTTTTT | 30 | 1862 |
| 803701 | N/A | N/A | 100073 | 100092 | AATCTACTGCACACAACACA | 89 | 1863 |
| 803702 | N/A | N/A | 100118 | 100137 | AATGGAGCCATTAATTATTA | 95 | 1864 |
| 803703 | N/A | N/A | 100281 | 100300 | ATTTCCTTACCTTTTCTACA | 103 | 1865 |
| 803704 | N/A | N/A | 100353 | 100372 | GCTTAAGGTAAAGTTTTTT | 33 | 1866 |

TABLE 24-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803705 | N/A | N/A | 100816 | 100835 | GCCAGCATTCAAACCCTCAA | 39 | 1867 |
| 803706 | N/A | N/A | 102479 | 102498 | ATGAGAGTAGATTTTAATAG | 85 | 1868 |
| 803707 | N/A | N/A | 102841 | 102860 | CTGAGTTCCAAAGCATTTAA | 80 | 1869 |
| 803708 | N/A | N/A | 103029 | 103048 | CACATTTTAATGCAGGAAAA | 97 | 1870 |
| 803709 | N/A | N/A | 105168 | 105187 | TGGATATAAGTGAATACACA | 71 | 1871 |
| 803710 | N/A | N/A | 105655 | 105674 | ATAGTGGCCCCTAAATCCTT | 83 | 1872 |
| 803711 | N/A | N/A | 105656 | 105675 | TATAGTGGCCCCTAAATCCT | 79 | 1873 |
| 803712 | N/A | N/A | 105657 | 105676 | ATATAGTGGCCCCTAAATCC | 73 | 1874 |
| 803713 | N/A | N/A | 105658 | 105677 | CATATAGTGGCCCCTAAATC | 88 | 1875 |
| 803714 | N/A | N/A | 105659 | 105678 | TCATATAGTGGCCCCTAAAT | 80 | 1876 |
| 803715 | N/A | N/A | 105661 | 105680 | AGTCATATAGTGGCCCCTAA | 46 | 1877 |
| 803716 | N/A | N/A | 105662 | 105681 | TAGTCATATAGTGGCCCCTA | 58 | 1878 |
| 803717 | N/A | N/A | 105663 | 105682 | ATAGTCATATAGTGGCCCCT | 57 | 1879 |
| 803718 | N/A | N/A | 105664 | 105683 | CATAGTCATATAGTGGCCCC | 49 | 1880 |
| 803719 | N/A | N/A | 105665 | 105684 | CCATAGTCATATAGTGGCCC | 35 | 1881 |
| 803720 | N/A | N/A | 105789 | 105808 | CTTCCAACTCATTCTCTCTC | 75 | 1882 |
| 803721 | N/A | N/A | 105839 | 105858 | GTGGCCTCAGAGCTTTCTGC | 62 | 1883 |
| 803722 | N/A | N/A | 105902 | 105921 | TCCACTGTGTAGCCTCATTT | 103 | 1884 |
| 803723 | N/A | N/A | 106062 | 106081 | AAGCCACATTTATTACCTTT | 49 | 1885 |
| 803724 | N/A | N/A | 106724 | 106743 | GAGAAATAACACAAAACTTT | 101 | 1886 |
| 803725 | N/A | N/A | 106922 | 106941 | GGCACTGAAAAGTCCCAAGT | 28 | 1887 |
| 803726 | N/A | N/A | 107295 | 107314 | AGTAGGAAATAGGATAAGCA | 79 | 1888 |
| 803727 | N/A | N/A | 108334 | 108353 | TTAACATGTAAGGACTGAAA | 97 | 1889 |
| 803728 | N/A | N/A | 108377 | 108396 | TGATGACATATCCACCACAT | 84 | 1890 |
| 803729 | N/A | N/A | 108774 | 108793 | TTTAGCTTACTACTATATAT | 91 | 1891 |
| 803730 | N/A | N/A | 109150 | 109169 | TAATGCAAGTAATACAAAAA | 102 | 1892 |
| 803731 | N/A | N/A | 109281 | 109300 | TTCTTTAACAATCAATAGAG | 79 | 1893 |
| 803732 | N/A | N/A | 109893 | 109912 | TATGGATGAAAAGTGAACAT | 91 | 1894 |
| 803733 | N/A | N/A | 110855 | 110874 | GAAATTACCTACACATTAAA | 103 | 1895 |
| 803734 | N/A | N/A | 110955 | 110974 | GACATTTTAATGTACTAAT | 63 | 1896 |
| 803735 | N/A | N/A | 111205 | 111224 | AATTTTCTATCCTGGAAAAG | 95 | 1897 |
| 803736 | N/A | N/A | 111262 | 111281 | AGAAGGAGTTAAGTTAGCTC | 51 | 1898 |
| 803737 | N/A | N/A | 112344 | 112363 | CAGTGTAGTCATACTAACAG | 58 | 1899 |
| 803738 | N/A | N/A | 112345 | 112364 | ACAGTGTAGTCATACTAACA | 54 | 1900 |
| 803739 | N/A | N/A | 112346 | 112365 | CACAGTGTAGTCATACTAAC | 58 | 1901 |
| 803740 | N/A | N/A | 112347 | 112366 | ACACAGTGTAGTCATACTAA | 31 | 1902 |
| 803741 | N/A | N/A | 112348 | 112367 | CACACAGTGTAGTCATACTA | 38 | 1903 |
| 803742 | N/A | N/A | 112350 | 112369 | TGCACACAGTGTAGTCATAC | 35 | 1904 |
| 803743 | N/A | N/A | 112351 | 112370 | GTGCACACAGTGTAGTCATA | 30 | 1905 |
| 803744 | N/A | N/A | 112352 | 112371 | AGTGCACACAGTGTAGTCAT | 27 | 1906 |
| 803745 | N/A | N/A | 112353 | 112372 | CAGTGCACACAGTGTAGTCA | 19 | 1907 |
| 803746 | N/A | N/A | 112354 | 112373 | ACAGTGCACACAGTGTAGTC | 45 | 1908 |
| 803747 | N/A | N/A | 112629 | 112648 | CTTGCTTTATGGTAAGAATG | 46 | 1909 |
| 803748 | N/A | N/A | 113302 | 113321 | CAAGTCTGGATCACACTTGT | 71 | 1910 |
| 803749 | N/A | N/A | 113398 | 113417 | AAAATTTGATCAGGGAAATG | 102 | 1911 |
| 803750 | N/A | N/A | 113772 | 113791 | GTGGAATAGTGATGAATCCC | 35 | 1912 |
| 803751 | N/A | N/A | 113824 | 113843 | AGACTATTTAAAAAATGGGA | 77 | 1913 |
| 803752 | N/A | N/A | 114604 | 114623 | CACAGTAATTCTGAAGGCTT | 64 | 1914 |
| 803753 | N/A | N/A | 114621 | 114640 | CCTTCCCCTACTGTCAACAC | 80 | 1915 |
| 803754 | N/A | N/A | 114658 | 114677 | CCCCAGGCACTGTTTTCCTT | 92 | 1916 |
| 803755 | N/A | N/A | 115071 | 115090 | GTTTCAGAGAACTAGAATAA | 65 | 1917 |
| 803756 | N/A | N/A | 115110 | 115129 | ACTTCATCAGAAACTGCTGG | 48 | 1918 |

TABLE 25

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780254 | 4111 | 4130 | 86606 | 86625 | GTTTCATTCGGTTATAAGGC | 24 | 235 |
| 780254 | 4111 | 4130 | 86606 | 86625 | GTTTCATTCGGTTATAAGGC | 26 | 235 |
| 803757 | N/A | N/A | 117459 | 117478 | AAAATTCTGATTTCCAACTC | 94 | 1919 |
| 803758 | N/A | N/A | 118016 | 118035 | GTATGTTAAATAAGAATTGA | 99 | 1920 |

TABLE 25-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803759 | N/A | N/A | 118692 | 118711 | CAATGTGATGCTTGCATTTT | 87 | 1921 |
| 803760 | N/A | N/A | 118987 | 119006 | TGACACCAAATTAGTCATTT | 55 | 1922 |
| 803761 | N/A | N/A | 119091 | 119110 | TGTACTCAAACATGTATATA | 75 | 1923 |
| 803762 | N/A | N/A | 119108 | 119127 | GGTCACGGCCAGCCCCTGT | 95 | 1924 |
| 803763 | N/A | N/A | 119608 | 119627 | AACATACACTTTGAAGTGTT | 62 | 1925 |
| 803764 | N/A | N/A | 119902 | 119921 | GTTAGGAGAGACTATAGAA | 73 | 1926 |
| 803765 | N/A | N/A | 119903 | 119922 | GGTTTAGGAGAGACTATAGA | 42 | 1927 |
| 803766 | N/A | N/A | 119904 | 119923 | TGGTTTAGGAGAGACTATAG | 43 | 1928 |
| 803767 | N/A | N/A | 119905 | 119924 | ATGGTTTAGGAGAGACTATA | 43 | 1929 |
| 803768 | N/A | N/A | 119906 | 119925 | TATGGTTTAGGAGAGACTAT | 49 | 1930 |
| 803769 | N/A | N/A | 119908 | 119927 | CATATGGTTTAGGAGAGACT | 28 | 1931 |
| 803770 | N/A | N/A | 119909 | 119928 | GCATATGGTTTAGGAGAGAC | 8 | 1932 |
| 803771 | N/A | N/A | 119910 | 119929 | TGCATATGGTTTAGGAGAGA | 14 | 1933 |
| 803772 | N/A | N/A | 119911 | 119930 | TTGCATATGGTTTAGGAGAG | 40 | 1934 |
| 803773 | N/A | N/A | 119912 | 119931 | GTTGCATATGGTTTAGGAGA | 21 | 1935 |
| 803774 | N/A | N/A | 120040 | 120059 | TCTATGGAATTTCATCCTTT | 62 | 1936 |
| 803775 | N/A | N/A | 120380 | 120399 | CAGCAAAACCAGGAAGTCAG | 75 | 1937 |
| 803776 | N/A | N/A | 121866 | 121885 | GTATTGTTGCCAAATGAATG | 50 | 1938 |
| 803777 | N/A | N/A | 121867 | 121886 | TGTATTGTTGCCAAATGAAT | 64 | 1939 |
| 803778 | N/A | N/A | 121868 | 121887 | ATGTATTGTTGCCAAATGAA | 66 | 1940 |
| 803779 | N/A | N/A | 121869 | 121888 | AATGTATTGTTGCCAAATGA | 77 | 1941 |
| 803780 | N/A | N/A | 121870 | 121889 | CAATGTATTGTTGCCAAATG | 56 | 1942 |
| 803781 | N/A | N/A | 121872 | 121891 | TTCAATGTATTGTTGCCAAA | 49 | 1943 |
| 803782 | N/A | N/A | 121873 | 121892 | GTTCAATGTATTGTTGCCAA | 21 | 1944 |
| 803783 | N/A | N/A | 121874 | 121893 | TGTTCAATGTATTGTTGCCA | 43 | 1945 |
| 803784 | N/A | N/A | 121875 | 121894 | ATGTTCAATGTATTGTTGCC | 38 | 1946 |
| 803785 | N/A | N/A | 121876 | 121895 | AATGTTCAATGTATTGTTGC | 57 | 1947 |
| 803786 | N/A | N/A | 122268 | 122287 | CACATCCTTTTACAATAGTT | 46 | 1948 |
| 803787 | N/A | N/A | 123076 | 123095 | AGGATGGAGACATCGAATTT | 67 | 1949 |
| 803788 | N/A | N/A | 123077 | 123096 | AAGGATGGAGACATCGAATT | 78 | 1950 |
| 803789 | N/A | N/A | 123078 | 123097 | GAAGGATGGAGACATCGAAT | 45 | 1951 |
| 803790 | N/A | N/A | 123079 | 123098 | GGAAGGATGGAGACATCGAA | 46 | 1952 |
| 803791 | N/A | N/A | 123080 | 123099 | TGGAAGGATGGAGACATCGA | 67 | 1953 |
| 803792 | N/A | N/A | 123082 | 123101 | GTTGGAAGGATGGAGACATC | 65 | 1954 |
| 803793 | N/A | N/A | 123083 | 123102 | AGTTGGAAGGATGGAGACAT | 54 | 1955 |
| 803794 | N/A | N/A | 123084 | 123103 | GAGTTGGAAGGATGGAGACA | 67 | 1956 |
| 803795 | N/A | N/A | 123085 | 123104 | AGAGTTGGAAGGATGGAGAC | 82 | 1957 |
| 803796 | N/A | N/A | 123086 | 123105 | AAGAGTTGGAAGGATGGAGA | 99 | 1958 |
| 803797 | N/A | N/A | 124014 | 124033 | TGGATAGACAGAAAGTTATC | 89 | 1959 |
| 803798 | N/A | N/A | 124460 | 124479 | TCCAGGACAGTGTTTTAAAA | 57 | 1960 |
| 803799 | N/A | N/A | 125043 | 125062 | AATCTTCATTGTAGAGAAAA | 96 | 1961 |
| 803800 | N/A | N/A | 125214 | 125233 | GCGGATTTTTTAAAAAGCCT | 44 | 1962 |
| 803801 | N/A | N/A | 126287 | 126306 | TAAAAAGAGACCCAAATAAC | 108 | 1963 |
| 803802 | N/A | N/A | 126714 | 126733 | TTTAATTCTGTCTCTGTGTG | 88 | 1964 |
| 803803 | N/A | N/A | 127951 | 127970 | GCTTGAGAAGACCTAAGTAA | 72 | 1965 |
| 803804 | N/A | N/A | 128819 | 128838 | GATGGTAACCTAAATTAAAA | 87 | 1966 |
| 803805 | N/A | N/A | 129120 | 129139 | AGAGCTGTGACATGGCCACC | 74 | 1967 |
| 803806 | N/A | N/A | 129202 | 129221 | TCTCTAGATTCTGTTTTTGA | 97 | 1968 |
| 803807 | N/A | N/A | 129512 | 129531 | CTGGAACCCAACTAGATCAC | 78 | 1969 |
| 803808 | N/A | N/A | 129985 | 130004 | TGATTCTAAAGCAAAACACA | 96 | 1970 |
| 803809 | N/A | N/A | 130212 | 130231 | CTTGCCTGGCAGTGGGAAAA | 120 | 1971 |
| 803810 | N/A | N/A | 130229 | 130248 | AATGAAAGACTGGCTCCCTT | 103 | 1972 |
| 803811 | N/A | N/A | 130358 | 130377 | GTTCAGAGATGTGCTATTTA | 61 | 1973 |
| 803812 | N/A | N/A | 130530 | 130549 | GCACAATATTTATCTTCAGG | 44 | 1974 |
| 803813 | N/A | N/A | 130540 | 130559 | TAATGTTGAGGCACAATATT | 121 | 1975 |
| 803814 | N/A | N/A | 132624 | 132643 | AAAGATCTGTAATTTCCCCA | 59 | 1976 |
| 803815 | N/A | N/A | 134408 | 134427 | AGCAATACAAATACAGCATA | 55 | 1977 |
| 803816 | N/A | N/A | 136673 | 136692 | GTAGGTAGACCAATGTAGAG | 73 | 1978 |
| 803817 | N/A | N/A | 137059 | 137078 | ATTAATAAAATACCTAGGAG | 110 | 1979 |
| 803818 | N/A | N/A | 137783 | 137802 | TACTAAGATTACAATGAGTT | 82 | 1980 |
| 803819 | N/A | N/A | 137934 | 137953 | TTCCTACAATCAATACTTAA | 86 | 1981 |
| 803820 | N/A | N/A | 138184 | 138203 | GAACTATGATTTATGCTCTT | 47 | 1982 |
| 803821 | N/A | N/A | 138715 | 138734 | ATTGCATCAGATTGATGTAC | 82 | 1983 |
| 803822 | N/A | N/A | 139321 | 139340 | AAAAATCCTCATTCATGGGA | 66 | 1984 |
| 803823 | N/A | N/A | 139750 | 139769 | TAAAGCATCTATGCTCCAAA | 47 | 1985 |
| 803824 | N/A | N/A | 140044 | 140063 | GCAGACCTAGAACTCCAAAA | 39 | 1986 |
| 803825 | N/A | N/A | 140485 | 140504 | AACAACGAGGAATATGTAAA | 91 | 1987 |
| 803826 | N/A | N/A | 140731 | 140750 | CAAAATAGACCAACCAGTCC | 87 | 1988 |
| 803827 | N/A | N/A | 140958 | 140977 | CATCCAAACATAAACAGAAA | 85 | 1989 |
| 803828 | N/A | N/A | 141091 | 141110 | GTTAGCCTTTTATACCTAGA | 29 | 1990 |
| 803829 | N/A | N/A | 141151 | 141170 | ATCTGTAACTTTTGAATGTT | 77 | 1991 |

TABLE 25-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 803830 | N/A | N/A | 142094 | 142113 | GGTCTTGATCCCCACTCCTT | 110 | 1992 |
| 803831 | N/A | N/A | 142406 | 142425 | TATCAAGGAGACCTGTTGGC | 114 | 1993 |
| 803832 | N/A | N/A | 142595 | 142614 | AAGTTTTACATGAAGTCTCA | 92 | 1994 |
| 803833 | N/A | N/A | 144471 | 144490 | AGCTGTTATGGGAACCCAAA | 60 | 1995 |

TABLE 26

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 24 | 222 |
| 803625 | N/A | N/A | 81585 87842 | 81604 87861 | TAGTGTTTGAAGGAATAGCT | 69 | 1787 |
| 876008 | 62 | 81 | 3181 | 3200 | CGTCCGCTGCTCAGGGAACC | 39 | 1996 |
| 876032 | 737 | 756 | 18636 | 18655 | AACGCACTTAACAATATCAT | 33 | 1997 |
| 876056 | 872 | 891 | 21703 | 21722 | ATAGCTTCCACCACAATATT | 71 | 1998 |
| 876080 | 1337 | 1356 | 31053 | 31072 | TTTGATGAAGAATGCATCAG | 83 | 1999 |
| 876104 | 1486 | 1505 | 35433 | 35452 | CACTTTCAGCCACTTCAGGA | 47 | 2000 |
| 876128 | 1728 | 1747 | 41961 | 41980 | AATATCATTCTTGAAACACT | 44 | 2001 |
| 876152 | 2493 | 2512 | 62114 | 62133 | ATCCAGGGCCAGCCTCCTTA | 76 | 2002 |
| 876176 | 3158 | 3177 | 73694 | 73713 | TGAAGCTCCAGCTTTTCAAG | 45 | 2003 |
| 876200 | 3571 | 3590 | 77320 | 77339 | TCTCCACTTTAGGACAAGCC | 35 | 2004 |
| 876224 | 3856 | 3875 | 82201 | 82220 | GATGCAGTTTCTCTACTCTA | 24 | 2005 |
| 876248 | 4319 | 4338 | 87223 | 87242 | GGATGAGTACTATAGAATTC | 41 | 2006 |
| 876272 | 4754 | 4773 | 92177 | 92196 | TTCCGGTCAATTACGGGAAA | 63 | 2007 |
| 876296 | 5075 | 5094 | 98223 | 98242 | ATCTGGAATTTTTCTAGGAG | 49 | 2008 |
| 876320 | 5482 | 5501 | 100471 | 100490 | CAGGAAACCATTCTTCCATG | 44 | 2009 |
| 876344 | 5833 | 5852 | 106524 | 106543 | GTTTATTAAAAATCTTCACA | 76 | 2010 |
| 876368 | 6603 | 6622 | 129748 | 129767 | AATGCTTGCATTCCTGCTGT | 70 | 2011 |
| 876392 | 7223 | 7242 | 141584 | 141603 | TCCACAACAGGGCTATTTTG | 75 | 2012 |
| 876416 | 8192 | 8211 | 146361 | 146380 | AATTCATTTGAATATTTACA | 89 | 2013 |
| 876440 | 9043 | 9062 | 147212 | 147231 | GTTAAAGCATAGCTTCCTTT | 63 | 2014 |
| 876464 | N/A | N/A | 4983 | 5002 | AATGAAGGTGGCCAGAATCA | 125 | 2015 |
| 876488 | N/A | N/A | 7242 | 7261 | AAGTGAGTATTAAAATGTCA | 112 | 2016 |
| 876512 | N/A | N/A | 9238 | 9257 | CAAAATGTAAGTTATCAGAA | 138 | 2017 |
| 876536 | N/A | N/A | 12445 | 12464 | TCAATAATGTTTAGTTAGTT | 85 | 2018 |
| 876560 | N/A | N/A | 15299 | 15318 | ACTATAGTACATGTATCTCA | 68 | 2019 |
| 876584 | N/A | N/A | 17431 | 17450 | TTATACATGACAGCCTGAAG | 121 | 2020 |
| 876608 | N/A | N/A | 19744 | 19763 | AGAACACTTATTACATACCA | 56 | 2021 |
| 876632 | N/A | N/A | 21991 | 22010 | TTTTTGACACTCCTTTTAAA | 93 | 2022 |
| 876656 | N/A | N/A | 25071 | 25090 | ACGATCATTCCTTATTATTC | 52 | 2023 |
| 876680 | N/A | N/A | 27616 | 27635 | GGCACGACAATATTCATTGT | 68 | 2024 |
| 876704 | N/A | N/A | 30008 | 30027 | CAACCTGCTGGCTAGTCACC | 40 | 2025 |
| 876728 | N/A | N/A | 32100 | 32119 | TAATTATACAAAGCTATAAG | 126 | 2026 |
| 876752 | N/A | N/A | 33547 | 33566 | ATAGAACATTTTACACACTA | 63 | 2027 |
| 876776 | N/A | N/A | 35959 | 35978 | AACCGCCAGCTATATAATCT | 73 | 2028 |
| 876800 | N/A | N/A | 38194 | 38213 | AGGTGATAACAGATGTCAGT | 104 | 2029 |
| 876824 | N/A | N/A | 39985 | 40004 | AGTAATAGATTGAAAGAAAC | 90 | 2030 |
| 876848 | N/A | N/A | 42029 | 42048 | TTAATAGTATAAATACAGAA | 119 | 2031 |
| 876872 | N/A | N/A | 45638 | 45657 | CCGACTGCTGAGGTTACACC | 64 | 2032 |
| 876896 | N/A | N/A | 47955 | 47974 | GTGAGGGAGAGGACATAAAG | 99 | 2033 |
| 876920 | N/A | N/A | 49786 | 49805 | TGTATTACATAGGTATGACT | 52 | 2034 |
| 876944 | N/A | N/A | 52148 | 52167 | CTTTAAAGATGCAGAAATAA | 100 | 2035 |
| 876968 | N/A | N/A | 55095 | 55114 | TTACCCGTGCATGCACCTGT | 119 | 2036 |
| 876992 | N/A | N/A | 57336 | 57355 | ATATTAAATACAGTAAGGTT | 115 | 2037 |
| 877016 | N/A | N/A | 60029 | 60048 | CCATTCACTCCTTACTTTGT | 66 | 2038 |
| 877040 | N/A | N/A | 62799 | 62818 | AAAGATAAAAATAGTGTCAG | 91 | 2039 |
| 877064 | N/A | N/A | 65735 | 65754 | CTCAAGTTTTTCCAGATGAT | 55 | 2040 |
| 877088 | N/A | N/A | 67068 | 67087 | AGGTTTCTTAAGTGGGATAC | 40 | 2041 |
| 877112 | N/A | N/A | 70290 | 70309 | GCTTAGAGACAAATTAAGGG | 37 | 2042 |
| 877136 | N/A | N/A | 72623 | 72642 | TTATATATAAATTCGAAAGA | 158 | 2043 |
| 877160 | N/A | N/A | 73942 | 73961 | TCAGATCTGTTTCCATTGCC | 31 | 2044 |

TABLE 26-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877184 | N/A | N/A | 75823 | 75842 | CAATTTCTAATTTTATAATG | 111 | 2045 |
| 877208 | N/A | N/A | 78402 | 78421 | ATTTCCTCTATTATTTCATA | 47 | 2046 |
| 877239 | N/A | N/A | 83094 | 83113 | AATACAGTATACAGGCCAGT | 32 | 2047 |
| 877263 | N/A | N/A | 85311 | 85330 | CATTACCTTTCTTGATTTAT | 85 | 2048 |
| 877287 | N/A | N/A | 88256 | 88275 | TTTCCTTTCCCATCTTCATG | 92 | 2049 |
| 877311 | N/A | N/A | 90591 | 90610 | GAGGACAAAAAATGATCTCT | 70 | 2050 |
| 877335 | N/A | N/A | 92465 | 92484 | CTAAATTTGTTTTCTTATGA | 129 | 2051 |
| 877359 | N/A | N/A | 94743 | 94762 | ACCAGGGAGGCAATATAGAA | 62 | 2052 |
| 877383 | N/A | N/A | 96119 | 96138 | CCACATGGAGAAGCACCAAT | 62 | 2053 |
| 877407 | N/A | N/A | 99047 | 99066 | AAAGTCAATGAAGGTAATCA | 56 | 2054 |
| 877431 | N/A | N/A | 101670 | 101689 | ATTAAGGCAAATACAAAGAT | 127 | 2055 |
| 877455 | N/A | N/A | 104228 | 104247 | GCTGCATTAATATGGAGTAT | 47 | 2056 |
| 877479 | N/A | N/A | 106092 | 106111 | TGCCCTTCCAACTCAATCAC | 82 | 2057 |
| 877503 | N/A | N/A | 108922 | 108941 | TTATAGATAAAACTTGAAGA | 126 | 2058 |
| 877527 | N/A | N/A | 111504 | 111523 | ATGCTTTAAACTGTGATTGC | 72 | 2059 |
| 877551 | N/A | N/A | 113499 | 113518 | TTAAGATGATGGGTTCTAGA | 77 | 2060 |
| 877575 | N/A | N/A | 116118 | 116137 | TGCAAGAAACACAAGTTGGA | 102 | 2061 |
| 877599 | N/A | N/A | 118373 | 118392 | ATGCACAGGAAATCTTATTC | 96 | 2062 |
| 877623 | N/A | N/A | 120463 | 120482 | ATATTGGAGATTAAAAGGGA | 121 | 2063 |
| 877647 | N/A | N/A | 122643 | 122662 | TTTACAAACGACATAATCCT | 117 | 2064 |
| 877671 | N/A | N/A | 126280 | 126299 | AGACCCAAATAACGATTTAA | 55 | 2065 |
| 877695 | N/A | N/A | 128683 | 128702 | CCAAATCAAGAGCTCACAAC | 91 | 2066 |
| 877719 | N/A | N/A | 133235 | 133254 | TAGTACTTTTTTTCCAATAC | 65 | 2067 |
| 877743 | N/A | N/A | 136955 | 136974 | AGATATTCATGCTCACAGAC | 142 | 2068 |
| 877767 | N/A | N/A | 140322 | 140341 | TGTTGTCAGAGAGCCACTAC | 71 | 2069 |
| 877791 | N/A | N/A | 141782 | 141801 | GAAGCATTACAAATTTTTTT | 105 | 2070 |
| 877815 | N/A | N/A | 144092 | 144111 | CCAAAGTACATACAATTCAA | 61 | 2071 |

TABLE 27

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 29 | 222 |
| 803626 | N/A | N/A | 81586 87843 | 81605 87862 | ATAGTGTTTGAAGGAATAGC | 50 | 1788 |
| 876009 | 191 | 210 | 3310 | 3329 | TTTCCTTCCTGGACATTGTT | 50 | 2072 |
| 876033 | 738 | 757 | 18637 | 18656 | TAACGCACTTAACAATATCA | 31 | 2073 |
| 876057 | 874 | 893 | 21705 | 21724 | TCATAGCTTCCACCACAATA | 74 | 2074 |
| 876081 | 1342 | 1361 | 31058 | 31077 | CTTCCTTTGATGAAGAATGC | 39 | 2075 |
| 876105 | 1487 | 1506 | 35434 | 35453 | CCACTTTCAGCCACTTCAGG | 55 | 2076 |
| 876129 | 1865 | 1884 | 52779 | 52798 | GAATCCATAGCACCTTCCAG | 62 | 2077 |
| 876153 | 2532 | 2551 | 62153 | 62172 | TATACAAAATCCTCCAAGGC | 71 | 2078 |
| 876177 | 3198 | 3217 | 73734 | 73753 | TTCACATAGCTGTTGTGGAA | 76 | 2079 |
| 876201 | 3576 | 3595 | 77325 | 77344 | GAAACTCTCCACTTTAGGAC | 30 | 2080 |
| 876225 | 3857 | 3876 | 82202 | 82221 | AGATGCAGTTTCTCTACTCT | 43 | 81 |
| 876249 | 4320 | 4339 | 87224 | 87243 | GGGATGAGTACTATAGAATT | 44 | 2081 |
| 876273 | 4755 | 4774 | 92178 | 92197 | TTTCCGGTCAATTACGGGAA | 48 | 2082 |
| 876297 | 5077 | 5096 | 98225 | 98244 | CAATCTGGAATTTTTCTAGG | 67 | 2083 |
| 876321 | 5522 | 5541 | 100511 | 100530 | AGAGTTTCTCCTTCACCACA | 42 | 2084 |
| 876345 | 5875 | 5894 | N/A | N/A | AAAGCACCACAAGCTCTTGT | 18* | 2085 |
| 876369 | 6605 | 6624 | 129750 | 129769 | CAAATGCTTGCATTCCTGCT | 61 | 2086 |
| 876393 | 7263 | 7282 | 141624 | 141643 | TATTAGTCCACAGAGTTTTT | 108 | 2087 |
| 876417 | 8267 | 8286 | 146436 | 146455 | GAAGTTGTGTAAGATGCACT | 83 | 2088 |
| 876441 | 9084 | 9103 | 147253 | 147272 | GAGCTCTATTATATATGATT | 68 | 2089 |
| 876465 | N/A | N/A | 5078 | 5097 | TTATCTAGACCCTGCAGACC | 105 | 2090 |
| 876489 | N/A | N/A | 7262 | 7281 | GAAGGAAAAATACTACTTTT | 92 | 2091 |
| 876513 | N/A | N/A | 9756 | 9775 | AGTTTTAGAGGTTGTACCAA | 62 | 2092 |
| 876537 | N/A | N/A | 12772 | 12791 | GTAGTGGGCCGGTGGCCGTT | 77 | 2093 |
| 876561 | N/A | N/A | 15455 | 15474 | GCTTAATTGCTCTACAGTCC | 48 | 2094 |
| 876585 | N/A | N/A | 17472 | 17491 | ATCCTAATTGTCATCGAAAG | 99 | 2095 |
| 876609 | N/A | N/A | 19783 | 19802 | ATAAAATACATATTGTCTAA | 97 | 2096 |

TABLE 27-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876633 | N/A | N/A | 22053 | 22072 | TATAGAACTACATCTATAAA | 103 | 2097 |
| 876657 | N/A | N/A | 25245 | 25264 | TACAAGTTGCTACAATGGAG | 69 | 2098 |
| 876681 | N/A | N/A | 27636 | 27655 | ATGTCATGTCTGTGACACAC | 65 | 2099 |
| 876705 | N/A | N/A | 30159 | 30178 | TTATGATGTTTGAATGGCAC | 108 | 2100 |
| 876729 | N/A | N/A | 32279 | 32298 | ATTTTTTGCCCTCTAAAAAT | 109 | 2101 |
| 876753 | N/A | N/A | 33681 | 33700 | CCCAGCAAATGCTGCTGGTC | 96 | 2102 |
| 876777 | N/A | N/A | 36087 | 36106 | TGTGCCAATTATTTTTTTTA | 84 | 2103 |
| 876801 | N/A | N/A | 38237 | 38256 | AATACAGACATAGGTGTTTT | 86 | 2104 |
| 876825 | N/A | N/A | 40148 | 40167 | TTCTTAAAGAATTTCACATT | 111 | 2105 |
| 876849 | N/A | N/A | 42157 | 42176 | TTTCACTTCCCACATCCCCA | 91 | 2106 |
| 876873 | N/A | N/A | 45665 | 45684 | CACAGCACTTACTTGCTCTC | 45 | 2107 |
| 876897 | N/A | N/A | 48048 | 48067 | AATTCCAGGAACCACAAACT | 98 | 2108 |
| 876921 | N/A | N/A | 49975 | 49994 | TCAGTACAGGTTAATGATGA | 63 | 2109 |
| 876945 | N/A | N/A | 52174 | 52193 | CAGCTTCATGTAATAGGTTT | 44 | 2110 |
| 876969 | N/A | N/A | 55241 | 55260 | CCTCTAATATTACATATTAA | 111 | 2111 |
| 876993 | N/A | N/A | 57372 | 57391 | AATCCATAGGCAAGTGGGAT | 63 | 2112 |
| 877017 | N/A | N/A | 60530 | 60549 | ACCATTTCTCCTCCCGGCTC | 83 | 2113 |
| 877041 | N/A | N/A | 62800 | 62819 | AAAAGATAAAAATAGTGTCA | 136 | 2114 |
| 877065 | N/A | N/A | 65802 | 65821 | TTCCTTGACCCATCACTTTA | 87 | 2115 |
| 877089 | N/A | N/A | 67069 | 67088 | AAGGTTTCTTAAGTGGGATA | 60 | 2116 |
| 877113 | N/A | N/A | 70299 | 70318 | TGGCCTTCTGCTTAGAGACA | 36 | 2117 |
| 877137 | N/A | N/A | 72643 | 72662 | ACTACTTTTTATAACTAAAT | 150 | 2118 |
| 877161 | N/A | N/A | 73943 | 73962 | ATCAGATCTGTTTCCATTGC | 36 | 2119 |
| 877185 | N/A | N/A | 76014 | 76033 | TTTGAATTAATGATTTAACA | 128 | 2120 |
| 877209 | N/A | N/A | 78477 | 78496 | GAATTCCTGTTTATTGTCAT | 64 | 2121 |
| 877240 | N/A | N/A | 83109 | 83128 | AGCTGAAAAACAAGTAATAC | 112 | 2122 |
| 877264 | N/A | N/A | 85425 | 85444 | AATTAGAGAAAAAGACTAAA | 117 | 2123 |
| 877288 | N/A | N/A | 88395 | 88414 | AAGAAAAGAACAACTGTCCT | 75 | 2124 |
| 877312 | N/A | N/A | 90592 | 90611 | AGAGGACAAAAAATGATCTC | 86 | 2125 |
| 877336 | N/A | N/A | 92591 | 92610 | ACATTATGAATGTCATTTGA | 111 | 2126 |
| 877360 | N/A | N/A | 94819 | 94838 | TCCTGATTAACATTCTTTAA | 76 | 2127 |
| 877384 | N/A | N/A | 96218 | 96237 | ATCTGCTTCATTTCTCTTGG | 60 | 2128 |
| 877408 | N/A | N/A | 99066 | 99085 | GCAAATGATTTTACTGCTTA | 52 | 2129 |
| 877432 | N/A | N/A | 101696 | 101715 | CTTATTTGCCTCCCATATCC | 112 | 2130 |
| 877456 | N/A | N/A | 104260 | 104279 | TTTTTAAAGCCCTTCTCTAT | 110 | 2131 |
| 877480 | N/A | N/A | 106129 | 106148 | CTACACTTCCAACTTTGTGT | 97 | 2132 |
| 877504 | N/A | N/A | 108958 | 108977 | GAAACCTGTAAGAGACAGTC | 111 | 2133 |
| 877528 | N/A | N/A | 111524 | 111543 | GTGTGATGTTAAATTGATTC | 58 | 2134 |
| 877552 | N/A | N/A | 113529 | 113548 | CATTTTTATAGAAGGCAGAT | 68 | 2135 |
| 877576 | N/A | N/A | 116214 | 116233 | ACTCTCCTACTAGACTGTAA | 69 | 2136 |
| 877600 | N/A | N/A | 118773 | 118792 | ATTCTCTTCTTTTTATTCAG | 64 | 2137 |
| 877624 | N/A | N/A | 120519 | 120538 | ATTAGGCCCTGGGTTTCTGA | 87 | 2138 |
| 877648 | N/A | N/A | 122804 | 122823 | AAGATAAAACATATCCCTAA | 83 | 2139 |
| 877672 | N/A | N/A | 126378 | 126397 | TTTATGTAAATTTACTTGTC | 108 | 2140 |
| 877696 | N/A | N/A | 128758 | 128777 | TAAAGTCATTATAGTTGTAC | 83 | 2141 |
| 877720 | N/A | N/A | 133258 | 133277 | AAAAAACAGGCTTCACATTT | 127 | 2142 |
| 877744 | N/A | N/A | 137015 | 137034 | ATCTCTATAAGGAAACCTGA | 120 | 2143 |
| 877768 | N/A | N/A | 140412 | 140431 | TTTAACAATCATTAGTATAT | 88 | 2144 |
| 877792 | N/A | N/A | 141884 | 141903 | GAGAACATTCTTTGTAATAC | 66 | 2145 |
| 877816 | N/A | N/A | 144288 | 144307 | TGAGAAGAACTGGATGTTCA | 65 | 2146 |

TABLE 28

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 38 | 222 |
| 780619 | N/A | N/A | 81587 87844 | 81606 87863 | CATAGTGTTTGAAGGAATAG | 91 | 669 |
| 876010 | 304 | 323 | 3695 | 3714 | AGACGATCAACAGAGGCACA | 56 | 2147 |
| 876034 | 740 | 759 | 18639 | 18658 | GTTAACGCACTTAACAATAT | 46 | 2148 |
| 876058 | 875 | 894 | 21706 | 21725 | TTCATAGCTTCCACCACAAT | 72 | 2149 |

TABLE 28-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876082 | 1403 | 1422 | N/A | N/A | TTTCTGAAATTAACATTTTG | 88 | 2150 |
| 876106 | 1489 | 1508 | 35436 | 35455 | AGCCACTTTCAGCCACTTCA | 41 | 2151 |
| 876130 | 1867 | 1886 | 52781 | 52800 | CTGAATCCATAGCACCTTCC | 55 | 2152 |
| 876154 | 2537 | 2556 | 62158 | 62177 | TTTCCTATACAAAATCCTCC | 55 | 2153 |
| 876178 | 3212 | 3231 | N/A | N/A | AAACTCTTCAGAGTTTCACA | 108 | 2154 |
| 876202 | 3615 | 3634 | N/A | N/A | CAAGAAAGGCATAGCAGCAA | 77 | 2155 |
| 876226 | 3858 | 3877 | 82203 | 82222 | AAGATGCAGTTTCTCTACTC | 105 | 2156 |
| 876250 | 4383 | 4402 | 87287 | 87306 | TTCAGCCTGTCCCTTGCTGA | 91 | 2157 |
| 876274 | 4757 | 4776 | 92180 | 92199 | CGTTTCCGGTCAATTACGGG | 32 | 2158 |
| 876298 | 5151 | 5170 | 99157 | 99176 | GGGAAGCTCTATCACAGGCC | 31 | 2159 |
| 876322 | 5543 | 5562 | 100532 | 100551 | TATAATGCCCATTTCTTCAA | 99 | 2160 |
| 876346 | 5880 | 5899 | 113077 | 113096 | GTGGCAAAGCACCACAAGCT | 35 | 2161 |
| 876370 | 6606 | 6625 | 129751 | 129770 | CCAAATGCTTGCATTCCTGC | 73 | 2162 |
| 876394 | 7324 | 7343 | 142972 | 142991 | TTTTGTGTTTTGATTCCTTG | 65 | 2163 |
| 876418 | 8308 | 8327 | 146477 | 146496 | TTTCATTAGTACTTTTAATG | 120 | 2164 |
| 876442 | 9131 | 9150 | 147300 | 147319 | AAATTGCAAATACAAAGTAA | 137 | 2165 |
| 876466 | N/A | N/A | 5103 | 5122 | CTGGGTTGTCAAGTATAGCA | 81 | 2166 |
| 876490 | N/A | N/A | 7469 | 7488 | TATCATGTTAAATGGCATCT | 56 | 2167 |
| 876514 | N/A | N/A | 9834 | 9853 | CATATAATTTCTAAATTATG | 126 | 2168 |
| 876538 | N/A | N/A | 12900 | 12919 | GTTGATATATTAAAATATAG | 101 | 2169 |
| 876562 | N/A | N/A | 15482 | 15501 | ATTCTCATCTAGAATGCAAA | 93 | 2170 |
| 876586 | N/A | N/A | 17692 | 17711 | TACTCTACATTTATAGTCAT | 117 | 2171 |
| 876610 | N/A | N/A | 19865 | 19884 | GAAGGCTCACACCTTCAGAT | 72 | 2172 |
| 876634 | N/A | N/A | 22186 | 22205 | TATACAACATTTAAGTTGGA | 95 | 2173 |
| 876658 | N/A | N/A | 25650 25680 25710 25740 25804 25868 | 25669 25699 25729 25759 25823 25887 | CATCTGTGTATAAATATGTA | 85 | 2174 |
| 876682 | N/A | N/A | 27649 | 27668 | CTGATTCCCTCTCATGTCAT | 63 | 2175 |
| 876706 | N/A | N/A | 30201 | 30220 | ACTCCTTGCTACAGCTTGTA | 40 | 2176 |
| 876730 | N/A | N/A | 32460 | 32479 | GGTGAGATGAAAAAGGAGGA | 64 | 2177 |
| 876754 | N/A | N/A | 33697 | 33716 | CTGTTTATCAAGTTCCCCCA | 61 | 2178 |
| 876778 | N/A | N/A | 36104 | 36123 | GTTTTCACTGCAACTTCTGT | 73 | 2179 |
| 876802 | N/A | N/A | 38252 | 38271 | TAAATGTGTTGGATGAATAC | 104 | 2180 |
| 876826 | N/A | N/A | 40280 | 40299 | TAGAGTTTCATATCCCTTTG | 58 | 2181 |
| 876850 | N/A | N/A | 42247 | 42266 | GAGTGGATTTATGTTACTGG | 35 | 2182 |
| 876874 | N/A | N/A | 45671 | 45690 | CCACATCACAGCACTTACTT | 60 | 2183 |
| 876898 | N/A | N/A | 48092 | 48111 | CATAGTCTGTAGGTAGTAGT | 54 | 2184 |
| 876922 | N/A | N/A | 50209 | 50228 | CGTTAATAATTTTCAAACAA | 145 | 2185 |
| 876946 | N/A | N/A | 52275 | 52294 | CTTGACCAGTAAAACGCAAT | 72 | 2186 |
| 876970 | N/A | N/A | 55359 | 55378 | CAGAGTCTGTCCTCTTCACT | 79 | 2187 |
| 876994 | N/A | N/A | 57490 | 57509 | GTTTATGTGATTTTAATTCA | 60 | 2188 |
| 877018 | N/A | N/A | 60774 | 60793 | AAGCACTACAGAGCTCTGAT | 75 | 2189 |
| 877042 | N/A | N/A | 63004 | 63023 | CTGACCAAAACTGGTGTTTT | 131 | 2190 |
| 877066 | N/A | N/A | 65861 | 65880 | TTTCCTGGAATATTAACCAT | 57 | 2191 |
| 877090 | N/A | N/A | 67071 | 67090 | AAAAGGTTTCTTAAGTGGGA | 70 | 2192 |
| 877114 | N/A | N/A | 70300 | 70319 | CTGGCCTTCTGCTTAGAGAC | 55 | 2193 |
| 877138 | N/A | N/A | 72664 | 72683 | ATATAATTTCTCATTAACCA | 79 | 2194 |
| 877162 | N/A | N/A | 73945 | 73964 | TAATCAGATCTGTTTCCATT | 52 | 2195 |
| 877186 | N/A | N/A | 76016 | 76035 | TATTTGAATTAATGATTTAA | 155 | 2196 |
| 877210 | N/A | N/A | 78507 | 78526 | TATTCTCTATGAAGGAAGAT | 72 | 2197 |
| 877241 | N/A | N/A | 83229 | 83248 | GACAAACAAATTATCAATTT | 70 | 2198 |
| 877265 | N/A | N/A | 86490 | 86509 | TCTTTTACATGTCACACTAT | 116 | 2199 |
| 877289 | N/A | N/A | 88459 | 88478 | TGTTGATATTTGCTTTCCGT | 45 | 2200 |
| 877313 | N/A | N/A | 90605 | 90624 | TGAAAAATAAATGAGAGGAC | 107 | 2201 |
| 877337 | N/A | N/A | 92763 | 92782 | GAGAATTTTCATCTTTGAGA | 42 | 2202 |
| 877361 | N/A | N/A | 94894 | 94913 | TTATTTGTCCCCATACATGA | 102 | 2203 |
| 877385 | N/A | N/A | 96275 | 96294 | GTAGCAGAATTAATATTTTT | 59 | 2204 |
| 877409 | N/A | N/A | 99079 | 99098 | CCAACCTTGTTGAGCAAATG | 109 | 2205 |
| 877433 | N/A | N/A | 101710 | 101729 | CACCTGAAAACTGTCTTATT | 123 | 2206 |
| 877457 | N/A | N/A | 104825 | 104844 | ACTGGAATCAGAAATAGAAT | 119 | 2207 |
| 877481 | N/A | N/A | 106421 | 106440 | AATTAAGCTGTCCAAGCGAA | 150 | 2208 |
| 877505 | N/A | N/A | 109331 | 109350 | TGAATGTGAAGAATGCCCAT | 97 | 2209 |
| 877529 | N/A | N/A | 111530 | 111549 | TAGCTTGTGTGATGTTAAAT | 56 | 2210 |
| 877553 | N/A | N/A | 113596 | 113615 | GACTCATCTTTCCTCATTGG | 52 | 2211 |
| 877577 | N/A | N/A | 116216 | 116235 | TGACTCTCCTACTAGACTGT | 66 | 2212 |
| 877601 | N/A | N/A | 118774 | 118793 | CATTCTCTTCTTTTTATTCA | 60 | 2213 |
| 877625 | N/A | N/A | 120524 | 120543 | AAAAGATTAGGCCCTGGGTT | 71 | 2214 |
| 877649 | N/A | N/A | 122888 | 122907 | ATTATACATTTCCTTAGAAT | 142 | 2215 |

TABLE 28-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877673 | N/A | N/A | 126380 | 126399 | TATTTATGTAAATTTACTTG | 115 | 2216 |
| 877697 | N/A | N/A | 128864 | 128883 | ATTTTTACTGTGGACATAAA | 96 | 2217 |
| 877721 | N/A | N/A | 133263 | 133282 | GGTACAAAAAACAGGCTTCA | 55 | 2218 |
| 877745 | N/A | N/A | 137032 | 137051 | AACAAAGATGATGAACGATC | 134 | 2219 |
| 877769 | N/A | N/A | 140492 | 140511 | ATGAATGAACAACGAGGAAT | 145 | 2220 |
| 877793 | N/A | N/A | 141955 | 141974 | TGTGACAGAACTATGTCAAA | 87 | 2221 |
| 877817 | N/A | N/A | 144304 | 144323 | AATATAGCATAGTAATTGAG | 109 | 2222 |

TABLE 29

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 32 | 222 |
| 803627 | N/A | N/A | 81588 87845 | 81607 87864 | CCATAGTGTTTGAAGGAATA | 47 | 1789 |
| 876011 | 309 | 328 | 3700 | 3719 | GTCCAAGACGATCAACAGAG | 47 | 2223 |
| 876035 | 797 | 816 | 18696 | 18715 | AGGGAATGTAAACAATGCAG | 41 | 2224 |
| 876059 | 876 | 895 | 21707 | 21726 | TTTCATAGCTTCCACCACAA | 59 | 2225 |
| 876083 | 1408 | 1427 | N/A | N/A | GTATTTTTCTGAAATTAACA | 87 | 2226 |
| 876107 | 1490 | 1509 | 35437 | 35456 | CAGCCACTTTCAGCCACTTC | 49 | 2227 |
| 876131 | 1952 | 1971 | 52992 | 53011 | TTCTTTGTAATCAAGTATCC | 110 | 2228 |
| 876155 | 2558 | 2577 | 62179 | 62198 | CCAAGCCAAGAAGGTTCAAC | 51 | 2229 |
| 876179 | 3214 | 3233 | N/A | N/A | TCAAACTCTTCAGAGTTTCA | 97 | 2230 |
| 876203 | 3620 | 3639 | 80900 | 80919 | GGAGGCAAGAAAGGCATAGC | 46 | 2231 |
| 876227 | 3860 | 3879 | 82205 | 82224 | GAAAGATGCAGTTTCTCTAC | 59 | 2232 |
| 876251 | 4388 | 4407 | 87292 | 87311 | TCAACTTCAGCCTGTCCCTT | 105 | 2233 |
| 876275 | 4781 | 4800 | 92204 | 92223 | TTTTCTCTCACTAGTTGTAA | 48 | 2234 |
| 876299 | 5191 | 5210 | 99197 | 99216 | TTTCATATAGTCGGATGATA | 72 | 2235 |
| 876323 | 5566 | 5585 | 100555 | 100574 | GTTCTTCACCATCATTAAAA | 61 | 2236 |
| 876347 | 5979 | 5998 | 113176 | 113195 | AAGCAGGCGATCCAAGGAAC | 112 | 2237 |
| 876371 | 6645 | 6664 | 129790 | 129809 | AAATGAGAGCTGTCCTCTGT | 71 | 2238 |
| 876395 | 7354 | 7373 | 143002 | 143021 | AGAGGGTTTTCACTCTCCCA | 60 | 2239 |
| 876419 | 8313 | 8332 | 146482 | 146501 | TGTTTTTTCATTAGTACTTT | 91 | 2240 |
| 876443 | 9170 | 9189 | 147339 | 147358 | AATATGGTATTCATTTTTTT | 100 | 2241 |
| 876467 | N/A | N/A | 5161 | 5180 | ATGCTCAGGCTTGGGCAATT | 64 | 2242 |
| 876491 | N/A | N/A | 7474 | 7493 | TGGAATATCATGTTAAATGG | 65 | 2243 |
| 876515 | N/A | N/A | 10519 | 10538 | AAATAAATACTCAAGGCCAT | 88 | 2244 |
| 876539 | N/A | N/A | 13003 | 13022 | TATTTTCACCCAACTCCATA | 126 | 2245 |
| 876563 | N/A | N/A | 15487 | 15506 | TTTGCATTCTCATCTAGAAT | 108 | 2246 |
| 876587 | N/A | N/A | 17742 | 17761 | CCCCTGAGTCCTGGAGAACC | 99 | 2247 |
| 876611 | N/A | N/A | 19889 | 19908 | ATTGGGTTTTACTCTGCCTA | 41 | 2248 |
| 876635 | N/A | N/A | 22443 | 22462 | CCACATGCAAAAATATTTCT | 57 | 2249 |
| 876659 | N/A | N/A | 25651 25681 25711 25741 25805 25869 | 25670 25700 25730 25760 25824 25888 | ACATCTGTGTATAAATATGT | 61 | 2250 |
| 876683 | N/A | N/A | 27820 | 27839 | GATGAATATTCAATGGCATT | 36 | 2251 |
| 876707 | N/A | N/A | 30247 | 30266 | AAAAACACAAAGGCTCACGGA | 73 | 2252 |
| 876731 | N/A | N/A | 32510 | 32529 | CTGTCAGTGCCCTGGCCACT | 42 | 2253 |
| 876755 | N/A | N/A | 33873 | 33892 | GTGGCTAGCTTCTAGCCAAG | 110 | 2254 |
| 876779 | N/A | N/A | 36197 | 36216 | TGTTATTATCATTCCTCTTT | 95 | 2255 |
| 876803 | N/A | N/A | 38423 | 38442 | AAAGCCTTTTATATATGCAT | 57 | 2256 |
| 876827 | N/A | N/A | 40345 | 40364 | CTTTTTAAGTCCTCCATATT | 65 | 2257 |
| 876851 | N/A | N/A | 42335 | 42354 | AGAAAACAGCAGCCATAGTA | 113 | 2258 |
| 876875 | N/A | N/A | 45683 | 45702 | AAGTGATTTTCTCCACATCA | 62 | 2259 |
| 876899 | N/A | N/A | 48094 | 48113 | TGCATAGTCTGTAGGTAGTA | 23 | 2260 |
| 876923 | N/A | N/A | 50229 | 50248 | TGTTGTCACCCTTGTAAAAT | 85 | 2261 |
| 876947 | N/A | N/A | 52382 | 52401 | AATTCACTGAGGGTTAGAAT | 82 | 2262 |
| 876971 | N/A | N/A | 55369 | 55388 | AGCACATCCCCAGAGTCTGT | 76 | 2263 |

TABLE 29-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876995 | N/A | N/A | 57777 | 57796 | TAAATTGAAAGAATAGTAGA | 147 | 2264 |
| 877019 | N/A | N/A | 60820 | 60839 | AAATGCCCACCAGTCTCCAA | 93 | 2265 |
| 877043 | N/A | N/A | 63105 | 63124 | AAACCTTGATGTATAAAGGC | 115 | 2266 |
| 877067 | N/A | N/A | 65930 | 65949 | TACACAAGCCACGAAAGGAT | 72 | 2267 |
| 877091 | N/A | N/A | 67193 | 67212 | TCTTCATTGACACACCACAC | 52 | 2268 |
| 877115 | N/A | N/A | 70305 | 70324 | TCACTCTGGCCTTCTGCTTA | 76 | 2269 |
| 877139 | N/A | N/A | 72670 | 72689 | ATATCCATATAATTTCTCAT | 97 | 2270 |
| 877163 | N/A | N/A | 74025 | 74044 | GAATTAAATGATTAAAGTAT | 91 | 2271 |
| 877187 | N/A | N/A | 76071 | 76090 | TTTTGTAAATTATTTCCAGA | 80 | 2272 |
| 877211 | N/A | N/A | 78563 | 78582 | AAAAATTATTTTACTGAGTC | 158 | 2273 |
| 877242 | N/A | N/A | 83232 | 83251 | TGAGACAAACAAATTATCAA | 55 | 2274 |
| 877266 | N/A | N/A | 86571 | 86590 | CGCTGTTGAAGAAACCTAGT | 62 | 2275 |
| 877290 | N/A | N/A | 88524 | 88543 | GAGCCTGGAGGGAAAGACAC | 99 | 2276 |
| 877314 | N/A | N/A | 90620 | 90639 | GATCAAAGGCAAATATGAAA | 81 | 2277 |
| 877338 | N/A | N/A | 92815 | 92834 | ATTTCTAGCAAGGTAATATG | 82 | 2278 |
| 877362 | N/A | N/A | 94924 | 94943 | GTACAGGATGCAGCTACCTA | 56 | 2279 |
| 877386 | N/A | N/A | 96286 | 96305 | GTTACTAGAATGTAGCAGAA | 74 | 2280 |
| 877410 | N/A | N/A | 99359 | 99378 | CATCTCCCTAATTTCTCTAA | 92 | 2281 |
| 877434 | N/A | N/A | 101744 | 101763 | GTCATTTTATAAAATATGGC | 95 | 2282 |
| 877458 | N/A | N/A | 104836 | 104855 | AACTGTTACATACTGGAATC | 109 | 2283 |
| 877482 | N/A | N/A | 106589 | 106608 | ATGTGCAATTTAATATAATT | 89 | 2284 |
| 877506 | N/A | N/A | 109785 | 109804 | ACTTGTGGCCCACAGGTCGC | 87 | 2285 |
| 877530 | N/A | N/A | 111542 | 111561 | TGTTGAAATGTATAGCTTGT | 57 | 2286 |
| 877554 | N/A | N/A | 113660 | 113679 | GACATGTGAGATGGTCATGC | 55 | 2287 |
| 877578 | N/A | N/A | 116500 | 116519 | TCTTCATAGCTTAAAGTAAA | 79 | 2288 |
| 877602 | N/A | N/A | 118817 | 118836 | GAATCTACAAATCTAACTTT | 118 | 2289 |
| 877626 | N/A | N/A | 120677 | 120696 | AAAAATTGGAGGCAGAGTTTA | 94 | 2290 |
| 877650 | N/A | N/A | 122924 | 122943 | ATATTGTTACAGATACAATG | 90 | 2291 |
| 877674 | N/A | N/A | 126393 | 126412 | CTCCATAATCCTATATTTAT | 83 | 2292 |
| 877698 | N/A | N/A | 128986 | 129005 | AAGTATGTCTAAGCTTTTA | 59 | 2293 |
| 877722 | N/A | N/A | 133331 | 133350 | TTGAAATTTTTCTTTGACCA | 36 | 2294 |
| 877746 | N/A | N/A | 137262 | 137281 | TTTCCATCTTAAATGATTAG | 86 | 2295 |
| 877770 | N/A | N/A | 140513 | 140532 | AATAGAAGAAGGCACTACAG | 111 | 2296 |
| 877794 | N/A | N/A | 142230 | 142249 | AAATAAAAATATAAAGTGGC | 154 | 2297 |
| 877818 | N/A | N/A | 144312 | 144331 | TGAGGCAAAATATAGCATAG | 93 | 2298 |

TABLE 30

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 43 | 222 |
| 780620 | N/A | N/A | 81590 87847 | 81609 87866 | AGCCATAGTGTTTGAAGGAA | 28 | 670 |
| 876013 | 339 | 358 | 3730 | 3749 | CTGCTGCACACTCGCGACTC | 55 | 2299 |
| 876037 | 821 | 840 | N/A | N/A | TCCACATTATTGCAAGGAAT | 51 | 2300 |
| 876061 | 930 | 949 | 21761 | 21780 | CCTATGGAGCAAACAGCAAC | 89 | 2301 |
| 876085 | 1455 | 1474 | 35402 | 35421 | CTTCTGCATTAACTCCAAAA | 49 | 2302 |
| 876109 | 1493 | 1512 | 35440 | 35459 | TTACAGCCACTTTCAGCCAC | 33 | 2303 |
| 876133 | 2042 | 2061 | 53082 | 53101 | TTAGTCTGTATTTCAGCAAC | 81 | 2304 |
| 876157 | 2626 | 2645 | 65464 | 65483 | TTCTTGCTAGTGTAGATGCT | 48 | 2305 |
| 876181 | 3216 | 3235 | N/A | N/A | TGTCAAACTCTTCAGAGTTT | 40 | 2306 |
| 876205 | 3703 | 3722 | N/A | N/A | AAGACCGCAAGTGTGGAAGA | 56 | 2307 |
| 876229 | 3929 | 3948 | 83924 | 83943 | CTGACATCCAGAGATGTCAG | 89 | 2308 |
| 876253 | 4432 | 4451 | N/A | N/A | AAGAAGCGCGAGCCTTTATA | 103 | 2309 |
| 876277 | 4877 | 4896 | 93338 | 93357 | AACTGCAGTGCTGGGTCTTG | 49 | 2310 |
| 876301 | 5194 | 5213 | 99200 | 99219 | GCATTTCATATAGTCGGATG | 22 | 2311 |
| 876325 | 5610 | 5629 | 100599 | 100618 | TTCCTCTGCTTTCTTCATCA | 56 | 2312 |
| 876349 | 6023 | 6042 | 113220 | 113239 | ATCCTGTGCTGTAGGGTTCT | 58 | 2313 |
| 876373 | 6689 | 6708 | N/A | N/A | TCAGCAACTTCCTCAGAAGT | 97 | 2314 |
| 876397 | 7400 | 7419 | 143048 | 143067 | TGGCCTCCTCCAGTTCCTAT | 73 | 2315 |
| 876421 | 8402 | 8421 | 146571 | 146590 | CTATTATGTCTAGGAAAGAC | 138 | 2316 |

TABLE 30-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876445 | N/A | N/A | 3487 | 3506 | CTCCTTAAGAGTCCGGGTTT | 103 | 2317 |
| 876469 | N/A | N/A | 5188 | 5207 | TGACACTCATAACTACTCCG | 68 | 2318 |
| 876493 | N/A | N/A | 7785 | 7804 | AATACAATTAAATTGGTAGT | 97 | 2319 |
| 876517 | N/A | N/A | 10746 | 10765 | AAAATCTACAACTTAACCAG | 107 | 2320 |
| 876541 | N/A | N/A | 13064 | 13083 | AAAAAGTTAAAAGCACTACT | 90 | 2321 |
| 876565 | N/A | N/A | 15570 | 15589 | CTTTAAGAATATCTCCTACA | 97 | 2322 |
| 876589 | N/A | N/A | 17908 | 17927 | AGTGATCAACATTCATTTTT | 58 | 2323 |
| 876613 | N/A | N/A | 19993 | 20012 | TTATTGTTCAGCCCCACCCA | 92 | 2324 |
| 876637 | N/A | N/A | 22715 | 22734 | CTATCCTGTGAACAATATTG | 74 | 2325 |
| 876661 | N/A | N/A | 25662 | 25681 | TATATTTATATACATCTGTG | 60 | 2326 |
|  |  |  | 25692 | 25711 |  |  |  |
|  |  |  | 25722 | 25741 |  |  |  |
|  |  |  | 25752 | 25771 |  |  |  |
|  |  |  | 25816 | 25835 |  |  |  |
|  |  |  | 25880 | 25899 |  |  |  |
| 876685 | N/A | N/A | 27910 | 27929 | AGTTAAGTGAAACATTAGCT | 98 | 2327 |
| 876709 | N/A | N/A | 30373 | 30392 | AACAAATAGACGGTCAAGAT | 58 | 2328 |
| 876733 | N/A | N/A | 32619 | 32638 | TCCCTGTCCAGACCTCTTTA | 83 | 2329 |
| 876757 | N/A | N/A | 33996 | 34015 | ATACTGCCAGAGCCTGAAAA | 81 | 2330 |
| 876781 | N/A | N/A | 36419 | 36438 | TTAGTTAGACTGATGTTAAA | 96 | 2331 |
| 876805 | N/A | N/A | 38456 | 38475 | GAAGAAATTATTTGTGCCTC | 56 | 2332 |
| 876829 | N/A | N/A | 40740 | 40759 | GAGGTCCTACTATTCAAATG | 49 | 2333 |
| 876853 | N/A | N/A | 42906 | 42925 | CTTCTCTTTTTCATACTCAG | 47 | 2334 |
| 876877 | N/A | N/A | 46382 | 46401 | AGAAGACTGGTTTTACTTTA | 78 | 2335 |
| 876901 | N/A | N/A | 48096 | 48115 | GGTGCATAGTCTGTAGGTAG | 28 | 2336 |
| 876925 | N/A | N/A | 50288 | 50307 | TTCACAGGTGTGTATTTCAC | 62 | 2337 |
| 876949 | N/A | N/A | 52569 | 52588 | AAATCAGTATCCTTGATTTT | 92 | 2338 |
| 876973 | N/A | N/A | 55733 | 55752 | GGAAAAAGAACTAATACCCT | 97 | 2339 |
| 876997 | N/A | N/A | 57805 | 57824 | AAAATCCTGTTGGGTAGAAA | 84 | 2340 |
| 877021 | N/A | N/A | 61061 | 61080 | CCCTTACAGCTAGCAAGCAA | 75 | 2341 |
| 877045 | N/A | N/A | 63132 | 63151 | AACTTTTGGAGCCTACTGAG | 79 | 2342 |
| 877069 | N/A | N/A | 66149 | 66168 | TCATTATATATTTCACCATA | 47 | 2343 |
| 877093 | N/A | N/A | 67368 | 67387 | TAAGAATAAGGTATAAATCA | 114 | 2344 |
| 877117 | N/A | N/A | 70856 | 70875 | ATTTTAAATTCCCCTACTCT | 87 | 2345 |
| 877141 | N/A | N/A | 72684 | 72703 | TGAGTGAAAAAGCTATATCC | 52 | 2346 |
| 877165 | N/A | N/A | 74316 | 74335 | AGAGCTATCCTATCAACAAA | 83 | 2347 |
| 877189 | N/A | N/A | 76262 | 76281 | CTTACACACCTCTGGTAACT | 47 | 2348 |
| 877213 | N/A | N/A | 78841 | 78860 | TTTGTCTGTGCTCTGAACTT | 69 | 2349 |
| 877244 | N/A | N/A | 83428 | 83447 | CCTAATTGGAGTAATTTCTT | 89 | 2350 |
| 877268 | N/A | N/A | 86896 | 86915 | TCCATACAGTCTACCAGGTT | 50 | 2351 |
| 877292 | N/A | N/A | 89032 | 89051 | GGCATCAAAAACATTTTCTC | 23 | 2352 |
| 877316 | N/A | N/A | 90814 | 90833 | AGATGCCTGCTCTGCTAATG | 83 | 2353 |
| 877340 | N/A | N/A | 93050 | 93069 | TTCACACATAAGTAGAAATT | 106 | 2354 |
| 877364 | N/A | N/A | 95117 | 95136 | CTGTATAAGATATACCCATC | 35 | 2355 |
| 877388 | N/A | N/A | 96349 | 96368 | TGCTATTCATATAGAGTCTC | 27 | 2356 |
| 877412 | N/A | N/A | 99735 | 99754 | ATTTTGGAAACCAGTAACAC | 94 | 2357 |
| 877436 | N/A | N/A | 101885 | 101904 | TTTGAGTATGTCACCATGTA | 59 | 2358 |
| 877460 | N/A | N/A | 104875 | 104894 | ATTAGTTAGGATTGTTGGTA | 62 | 2359 |
| 877484 | N/A | N/A | 106759 | 106778 | AGGATTCTCAGATACAGTGT | 99 | 2360 |
| 877508 | N/A | N/A | 109926 | 109945 | AATCCTATGGTGAGTACCTC | 94 | 2361 |
| 877532 | N/A | N/A | 111674 | 111693 | GATCCAATGGCAACAACCCT | 97 | 2362 |
| 877556 | N/A | N/A | 113970 | 113989 | GGAATGTAAGGTGACTCTCA | 80 | 2363 |
| 877580 | N/A | N/A | 116687 | 116706 | AGACTAGCAAAATAGCTTTT | 97 | 2364 |
| 877604 | N/A | N/A | 118908 | 118927 | GTGGACCTGAATTTGATTTG | 58 | 2365 |
| 877628 | N/A | N/A | 120831 | 120850 | AGGAAGATTCATTAAACGGA | 76 | 2366 |
| 877652 | N/A | N/A | 123128 | 123147 | AAAGATGGAGCTCAGCAGTC | 89 | 2367 |
| 877676 | N/A | N/A | 126731 | 126750 | TTTGCCTTATAACTATTTTT | 92 | 2368 |
| 877700 | N/A | N/A | 129195 | 129214 | ATTCTGTTTTTGATCTGGAG | 78 | 2369 |
| 877724 | N/A | N/A | 133350 | 133369 | CCTTGCCCAATTCCATCCAT | 49 | 2370 |
| 877748 | N/A | N/A | 138041 | 138060 | TATTCTTGTTTGAAACTGGT | 46 | 2371 |
| 877772 | N/A | N/A | 140642 | 140661 | CCCTCACACTAGATTATGAG | 72 | 2372 |
| 877796 | N/A | N/A | 142347 | 142366 | AGAAAAACTGTCAGATGAAT | 116 | 2373 |
| 877820 | N/A | N/A | 144537 | 144556 | ATATTCTAGTGAAGAGACTA | 164 | 2374 |

TABLE 31

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 19 | 222 |
| 780621 | N/A | N/A | 81593 87850 | 81612 87869 | AAAAGCCATAGTGTTTGAAG | 35 | 671 |
| 876016 | 395 | 414 | 10419 | 10438 | CTTTGCATTGTACCTGGACA | 37 | 2375 |
| 876040 | 825 | 844 | N/A | N/A | GACTTCCACATTATTGCAAG | 36 | 2376 |
| 876064 | 1070 | 1089 | N/A | N/A | ATAGTCTCAGTGAGGAGGGC | 50 | 2377 |
| 876088 | 1468 | 1487 | 35415 | 35434 | GAGAATGTATATGCTTCTGC | 15 | 2378 |
| 876112 | 1539 | 1558 | 37588 | 37607 | TATATCCAGGGAAGTGTTGC | 71 | 2379 |
| 876136 | 2091 | 2110 | 56025 | 56044 | AGAAAAAGATGCTGACAATT | 86 | 2380 |
| 876160 | 2802 | 2821 | N/A | N/A | GCCTTCACTTCCTTCACTAT | 59 | 2381 |
| 876184 | 3223 | 3242 | 76357 | 76376 | CCAAATGTGTCAAACTCTTC | 39 | 2382 |
| 876208 | 3791 | 3810 | 82136 | 82155 | TTATGGCTAAATAAGAGTTC | 69 | 2383 |
| 876232 | 4012 | 4031 | 84007 | 84026 | GATGCAGTTCATCCAAAGGA | 35 | 2384 |
| 876256 | 4609 | 4628 | 88710 | 88729 | TTTTCCGAAGTTTTGCCAAA | 73 | 2385 |
| 876280 | 4967 | 4986 | 98115 | 98134 | GGGTGTTTTGGACAACCTTC | 37 | 2386 |
| 876304 | 5198 | 5217 | 99204 | 99223 | TAAGGCATTTCATATAGTCG | 48 | 2387 |
| 876328 | 5647 | 5666 | 101285 | 101304 | TGAGCCTTGGTTGATCTGGA | 21 | 2388 |
| 876352 | 6072 | 6091 | 118405 | 118424 | AATCATGGCTGAGTGGAGGT | 80 | 2389 |
| 876376 | 6738 | 6757 | 132448 | 132467 | TTCCTTTTCAACAGGAAGAT | 68 | 2390 |
| 876400 | 7495 | 7514 | N/A | N/A | TTCCTAGCTGTGCTGTCATC | 91 | 2391 |
| 876424 | 8539 | 8558 | 146708 | 146727 | GAAGCAGATTAGAAAACAAG | 86 | 2392 |
| 876448 | N/A | N/A | 3736 | 3755 | CTTTACCTGCTGCACACTCG | 63 | 2393 |
| 876472 | N/A | N/A | 5572 | 5591 | CCAGAGACTGGAAATGAAAG | 95 | 2394 |
| 876496 | N/A | N/A | 7851 | 7870 | TCCATTAATCTATTCAATTA | 78 | 2395 |
| 876520 | N/A | N/A | 10808 | 10827 | GTATCGATTCTATTATTAAA | 71 | 2396 |
| 876544 | N/A | N/A | 13929 | 13948 | AATCAAGCTACCCTAATCCT | 95 | 2397 |
| 876568 | N/A | N/A | 15860 | 15879 | TAAATGAGATAAACTCCCAG | 96 | 2398 |
| 876592 | N/A | N/A | 18000 | 18019 | TATTGGGCAACAACCTGAAA | 95 | 2399 |
| 876616 | N/A | N/A | 20210 | 20229 | TTTTAGCTGCTACTTTCTTG | 84 | 2400 |
| 876640 | N/A | N/A | 23220 | 23239 | GATACATAAAAAAGAGTAAA | 135 | 2401 |
| 876664 | N/A | N/A | 26207 | 26226 | AGATTAAAACATTATCAGAT | 84 | 2402 |
| 876688 | N/A | N/A | 28199 | 28218 | ACAACTGTTAGTTTCCTTGA | 55 | 2403 |
| 876712 | N/A | N/A | 30796 | 30815 | TTTCAAAAGCATATGCAGCA | 51 | 2404 |
| 876736 | N/A | N/A | 32794 | 32813 | CAGTCGAAATTTCACAAAGT | 66 | 2405 |
| 876760 | N/A | N/A | 34084 | 34103 | CTTAAGTACTGCTTTTAAAA | 69 | 2406 |
| 876784 | N/A | N/A | 36835 | 36854 | CCTCCCCTCCTTGGGTAACC | 93 | 2407 |
| 876808 | N/A | N/A | 38630 | 38649 | TCAGCCTTTCCTTCCACACT | 74 | 2408 |
| 876832 | N/A | N/A | 40891 | 40910 | TATTACACCTTAAGAAGATG | 106 | 2409 |
| 876856 | N/A | N/A | 42932 | 42951 | TTACACAATTTAAATGTAAT | 104 | 2410 |
| 876880 | N/A | N/A | 46724 | 46743 | TTAGTTCCAGAAAATACTAT | 71 | 2411 |
| 876904 | N/A | N/A | 48100 | 48119 | CCAGGGTGCATAGTCTGTAG | 44 | 2412 |
| 876928 | N/A | N/A | 50374 | 50393 | CTTCTACAAAAAAAAGTCAG | 87 | 2413 |
| 876952 | N/A | N/A | 52953 | 52972 | CACTGAATTTCTAGGAAAAT | 117 | 2414 |
| 876976 | N/A | N/A | 56393 | 56412 | AGAATACTGAGCAAAGACAA | 88 | 2415 |
| 877000 | N/A | N/A | 58100 | 58119 | GTCTAACACAACTCCACCCT | 95 | 2416 |
| 877024 | N/A | N/A | 61215 | 61234 | CCAAGATAACAGGTAATAGA | 60 | 2417 |
| 877048 | N/A | N/A | 63290 | 63309 | CTTCCAGACTGGTGATAGCA | 97 | 2418 |
| 877072 | N/A | N/A | 66302 | 66321 | AGACACAATATTTTGGAACA | 53 | 2419 |
| 877096 | N/A | N/A | 67753 | 67772 | GTTAGAAATTTTAAAAGACT | 86 | 2420 |
| 877120 | N/A | N/A | 71190 | 71209 | CTGGAATAGGGTCTAGCAGC | 37 | 2421 |
| 877144 | N/A | N/A | 72946 | 72965 | AAAAATGGGCCCCTATTAAA | 102 | 2422 |
| 877168 | N/A | N/A | 74838 | 74857 | TCCCTTAAATATACTTAAAA | 101 | 2423 |
| 877192 | N/A | N/A | 76677 | 76696 | GTTGTTAAAACTCATTGCTA | 38 | 2424 |
| 877216 | N/A | N/A | 79254 | 79273 | GACCACTTCTCAAACTATTA | 64 | 2425 |
| 877247 | N/A | N/A | 83670 | 83689 | CTCCCAAACAATCTATGTCA | 41 | 2426 |
| 877271 | N/A | N/A | 87005 | 87024 | AACCGATCAAAGTACCTAGC | 36 | 2427 |
| 877295 | N/A | N/A | 89220 | 89239 | CACAGTGACAAAATTCATGA | 50 | 2428 |
| 877319 | N/A | N/A | 91037 | 91056 | TATCTCTTAACCCAGAGAAT | 79 | 2429 |
| 877343 | N/A | N/A | 93174 | 93193 | CTGGGACTAGAAGCTGTGCA | 37 | 2430 |
| 877367 | N/A | N/A | 95220 | 95239 | ACTTAATTACTCCACAGAAT | 91 | 2431 |
| 877391 | N/A | N/A | 96751 | 96770 | TTCTCTCATTTGAATATCAG | 63 | 2432 |
| 877415 | N/A | N/A | 99949 | 99968 | TAAAAAGAGTTAAATCCCCT | 88 | 2433 |
| 877439 | N/A | N/A | 102322 | 102341 | TGTACAAAGTATATCTTTTT | 45 | 2434 |
| 877463 | N/A | N/A | 104975 | 104994 | ATTAGATTGTAAATATGTTA | 147 | 2435 |
| 877487 | N/A | N/A | 106908 | 106927 | CCAAGTTTCTACATTTCTAA | 64 | 2436 |
| 877511 | N/A | N/A | 110185 | 110204 | TTGTTGAGAAAAGCACAGAT | 94 | 2437 |
| 877535 | N/A | N/A | 111992 | 112011 | CATTGGCATTCATTCAATCC | 73 | 2438 |
| 877559 | N/A | N/A | 114281 | 114300 | GGTATCTGCAAGGAACCTCA | 87 | 2439 |
| 877583 | N/A | N/A | 117201 | 117220 | TTCAATTGTATGAGGGCCTG | 102 | 2440 |
| 877607 | N/A | N/A | 119250 | 119269 | TTACTTCCTGCTCAAACTGA | 99 | 2441 |
| 877631 | N/A | N/A | 121200 | 121219 | CAGGAGCTCTGCTCTCAGGC | 67 | 2442 |

TABLE 31-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877655 | N/A | N/A | 123752 | 123771 | GTACTACTCTTTCTTTCTTT | 62 | 2443 |
| 877679 | N/A | N/A | 126891 | 126910 | TTTTTTCTGATTTGATTTGT | 81 | 2444 |
| 877703 | N/A | N/A | 129329 | 129348 | GCATGCAATTCTATATTGCA | 100 | 2445 |
| 877727 | N/A | N/A | 133490 | 133509 | CCCACTTCCTTCCAACAAGG | 77 | 2446 |
| 877751 | N/A | N/A | 138235 | 138254 | GAAAGGTTATTGCCCAAGTT | 45 | 2447 |
| 877775 | N/A | N/A | 140814 | 140833 | GCCACATCAGCATGGCAAAC | 50 | 2448 |
| 877799 | N/A | N/A | 142668 | 142687 | TACCAAAGCTATCTAATTCA | 99 | 2449 |
| 877823 | N/A | N/A | 144798 | 144817 | TTAAACGAGGTAATGTGTGT | 60 | 2450 |

TABLE 32

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 37 | 222 |
| 803631 | N/A | N/A | 81594 87851 | 81613 87870 | AAAAAGCCATAGTGTTTGAA | 80 | 1793 |
| 876017 | 400 | 419 | 10424 | 10443 | TTAAGCTTTGCATTGTACCT | 40 | 2451 |
| 876041 | 827 | 846 | N/A | N/A | AGGACTTCCACATTATTGCA | 37 | 2452 |
| 876065 | 1084 | 1103 | 29345 | 29364 | CTTGATTTAAGAAAATAGTC | 83 | 2453 |
| 876089 | 1469 | 1488 | 35416 | 35435 | GGAGAATGTATATGCTTCTG | 27 | 2454 |
| 876113 | 1555 | 1574 | 37604 | 37623 | GGACCACTGCTGCCATTATA | 43 | 2455 |
| 876137 | 2130 | 2149 | 56064 | 56083 | GAATATTACTAAGTCAAATG | 84 | 2456 |
| 876161 | 2843 | 2862 | 71686 | 71705 | CCTACACTAATTGAATTAGA | 52 | 2457 |
| 876185 | 3224 | 3243 | 76358 | 76377 | TCCAAATGTGTCAAACTCTT | 31 | 2458 |
| 876209 | 3796 | 3815 | 82141 | 82160 | TCTGATTATGGCTAAATAAG | 41 | 2459 |
| 876233 | 4017 | 4036 | 84012 | 84031 | GTTAAGATGCAGTTCATCCA | 55 | 2460 |
| 876257 | 4621 | 4640 | 88722 | 88741 | CGTTTATGATGGTTTTCCGA | 79 | 2461 |
| 876281 | 5042 | 5061 | 98190 | 98209 | GACATGTAGTTCTTTGGAAA | 44 | 2462 |
| 876305 | 5199 | 5218 | 99205 | 99224 | ATAAGGCATTTCATATAGTC | 74 | 2463 |
| 876329 | 5648 | 5667 | 101286 | 101305 | GTGAGCCTTGGTTGATCTGG | 55 | 2464 |
| 876353 | 6093 | 6112 | 118426 | 118445 | GGGTTTCAGGTCTCGGTATA | 72 | 2465 |
| 876377 | 6777 | 6796 | 132487 | 132506 | CAGGAGAGTACCAGACTGTG | 71 | 2466 |
| 876401 | 7516 | 7535 | 145119 | 145138 | CCAGCATGACATTTTTAAGG | 37 | 2467 |
| 876425 | 8551 | 8570 | 146720 | 146739 | AAGCATTAGAATGAAGCAGA | 56 | 2468 |
| 876449 | N/A | N/A | 3738 | 3757 | GCCTTTACCTGCTGCACACT | 69 | 2469 |
| 876473 | N/A | N/A | 5806 | 5825 | CTCTAAATTAATTACTTAAC | 97 | 2470 |
| 876497 | N/A | N/A | 7895 | 7914 | TGATTAAATAGAATCTCTGG | 89 | 2471 |
| 876521 | N/A | N/A | 10905 | 10924 | AAATGTACTATTTAAAGACA | 84 | 2472 |
| 876545 | N/A | N/A | 13978 | 13997 | GGCTGTCCCATCACTAGGTC | 40 | 2473 |
| 876569 | N/A | N/A | 15888 | 15907 | GTTAGACTTATCAAGCTCTA | 41 | 2474 |
| 876593 | N/A | N/A | 18037 | 18056 | TTTGATCAAGCCAGTAAGTT | 47 | 2475 |
| 876617 | N/A | N/A | 20433 | 20452 | TGTTTAAAAAAAGGCTGTTT | 88 | 2476 |
| 876641 | N/A | N/A | 23260 | 23279 | ATTATCTTAGGGAAAGGACA | 83 | 2477 |
| 876665 | N/A | N/A | 26250 | 26269 | TGTGCTACTCTGACACCTGG | 41 | 2478 |
| 876689 | N/A | N/A | 28210 | 28229 | GTATATTTGTCACAACTGTT | 52 | 2479 |
| 876713 | N/A | N/A | 30800 | 30819 | GCTTTTTCAAAAGCATATGC | 35 | 2480 |
| 876737 | N/A | N/A | 32826 | 32845 | TGTAACCAGTCCTCAGACAC | 73 | 2481 |
| 876761 | N/A | N/A | 34100 | 34119 | ACATAAAAAGTTTTAACTTA | 105 | 2482 |
| 876785 | N/A | N/A | 36869 | 36888 | AAAGTCCCAGTTTAAACACA | 73 | 2483 |
| 876809 | N/A | N/A | 38643 | 38662 | TTTTCTTTGGGCCTCAGCCT | 110 | 2484 |
| 876833 | N/A | N/A | 40900 | 40919 | GAGGCTGCCTATTACACCTT | 60 | 2485 |
| 876857 | N/A | N/A | 42939 | 42958 | TTTTGCATTACACAATTTAA | 74 | 2486 |
| 876881 | N/A | N/A | 46818 | 46837 | TGGAGTTAGGCCATATGAAT | 45 | 2487 |
| 876905 | N/A | N/A | 48102 | 48121 | GTCCAGGGTGCATAGTCTGT | 28 | 2488 |
| 876929 | N/A | N/A | 50419 | 50438 | TACCAGTATCTTAAATTCAG | 93 | 2489 |
| 876953 | N/A | N/A | 53117 | 53136 | AGTTCCCAAATTCTTTCCAA | 86 | 2490 |
| 876977 | N/A | N/A | 56418 | 56437 | AATGGCAGGGCTCTTACATT | 45 | 2491 |
| 877001 | N/A | N/A | 58449 | 58468 | GAGCCACCCTGCATGAAGCT | 74 | 2492 |
| 877025 | N/A | N/A | 61291 | 61310 | GCACTGCATGCTGGCCCTAC | 122 | 2493 |
| 877049 | N/A | N/A | 63355 | 63374 | TTATATAATGTGGTGAATGG | 124 | 2494 |
| 877073 | N/A | N/A | 66309 | 66328 | TGACTTGAGACACAATATTT | 52 | 2495 |

TABLE 32-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877097 | N/A | N/A | 67953 | 67972 | ATTGTGAACAAAGAAAATCC | 110 | 2496 |
| 877121 | N/A | N/A | 71306 | 71325 | CAAATCAATCAACGGTTACA | 60 | 2497 |
| 877145 | N/A | N/A | 73081 | 73100 | TAATTGGAGGAAATTCAACC | 113 | 2498 |
| 877169 | N/A | N/A | 74847 | 74866 | GAAAAAACATCCCTTAAATA | 119 | 2499 |
| 877193 | N/A | N/A | 77052 | 77071 | TAAAAGTTGTAATATTCATT | 88 | 2500 |
| 877217 | N/A | N/A | 79613 | 79632 | TTCAGAGTCTTGAGTTTCAT | 51 | 2501 |
| 877248 | N/A | N/A | 84372 | 84391 | TCTTTAGATTGTGTAATTGG | 43 | 2502 |
| 877272 | N/A | N/A | 87027 | 87046 | CACTTTTAGCATATTTGTCA | 80 | 2503 |
| 877296 | N/A | N/A | 89765 | 89784 | AAATGGAACAGAACTAAGCT | 100 | 2504 |
| 877320 | N/A | N/A | 91067 | 91086 | CAAATGGTTACTCAAGAGAC | 68 | 2505 |
| 877344 | N/A | N/A | 93198 | 93217 | ATTTCAGCATAGCTAGTGAC | 102 | 2506 |
| 877368 | N/A | N/A | 95236 | 95255 | CTTTCATGGAGTTTCAACTT | 100 | 2507 |
| 877392 | N/A | N/A | 96941 | 96960 | TCCCATGTTGTGTACTTTAT | 36 | 2508 |
| 877416 | N/A | N/A | 100066 | 100085 | TGCACACAACACAAGTGATT | 64 | 2509 |
| 877440 | N/A | N/A | 102409 | 102428 | TCTCCATTCCACAACATATA | 98 | 2510 |
| 877464 | N/A | N/A | 105094 | 105113 | ATGGAAAGCCTCTACCTATT | 111 | 2511 |
| 877488 | N/A | N/A | 106972 | 106991 | TGGAGGCAGCTAGGAGTCTG | 100 | 2512 |
| 877512 | N/A | N/A | 110233 | 110252 | CAAAGGCCTAAAGCCAATTA | 128 | 2513 |
| 877536 | N/A | N/A | 112047 | 112066 | AGGCCTTCCAGACCTTCTCG | 108 | 2514 |
| 877560 | N/A | N/A | 114295 | 114314 | GATATAAAGCCTCTGGTATC | 98 | 2515 |
| 877584 | N/A | N/A | 117209 | 117228 | CCTGAACTTTCAATTGTATG | 73 | 2516 |
| 877608 | N/A | N/A | 119259 | 119278 | CTAAATGATTTACTTCCTGC | 77 | 2517 |
| 877632 | N/A | N/A | 121414 | 121433 | TGCCTAGGACCCAGAATTA | 146 | 2518 |
| 877656 | N/A | N/A | 124006 | 124025 | CAGAAAGTTATCAAATATGT | 90 | 2519 |
| 877680 | N/A | N/A | 126954 | 126973 | AGCTCGAAAAAGAAATTGCA | 80 | 2520 |
| 877704 | N/A | N/A | 129393 | 129412 | TAACTTGAAAAGAAAATCTC | 105 | 2521 |
| 877728 | N/A | N/A | 133512 | 133531 | CCTAATCACATTGACAACTG | 101 | 2522 |
| 877752 | N/A | N/A | 138252 | 138271 | GAGATGACTGAAGATGTGAA | 73 | 2523 |
| 877776 | N/A | N/A | 140877 | 140896 | TTTCCCTTTCAACCTAAGAC | 99 | 2524 |
| 877800 | N/A | N/A | 142754 | 142773 | CTTTACTTGAAGCATAAATT | 93 | 2525 |
| 877824 | N/A | N/A | 144813 | 144832 | CCCAAAGTTACAATGTTAAA | 72 | 2526 |

TABLE 33

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 38 | 222 |
| 780622 | N/A | N/A | 81596 87853 | 81615 87872 | CTAAAAAGCCATAGTGTTTG | 53 | 672 |
| 876019 | 486 | 505 | 13752 | 13771 | ACTGGCATTATGAACTGTTA | 37 | 2527 |
| 876043 | 829 | 848 | 21660 | 21679 | TGAGGACTTCCACATTATTG | 47 | 2528 |
| 876067 | 1156 | 1175 | 29417 | 29436 | CTTCCAGCCAAAACAATTTA | 99 | 2529 |
| 876091 | 1472 | 1491 | 35419 | 35438 | TCAGGAGAATGTATATGCTT | 47 | 2530 |
| 876115 | 1613 | 1632 | 37662 | 37681 | GCCTCCAGCTGCACTGGTAA | 58 | 2531 |
| 876139 | 2223 | 2242 | 56231 | 56250 | GTAATCATCCATAGCTACTT | 31 | 2532 |
| 876163 | 2867 | 2886 | 71710 | 71729 | AATACGGCATCTCGGTAAAA | 77 | 2533 |
| 876187 | 3227 | 3246 | 76361 | 76380 | AAGTCCAAATGTGTCAAACT | 44 | 2534 |
| 876211 | 3799 | 3818 | 82144 | 82163 | TGATCTGATTATGGCTAAAT | 49 | 2535 |
| 876235 | 4053 | 4072 | 84048 | 84067 | GTCTTTGGCTTTACATCCTA | 48 | 2536 |
| 876259 | 4697 | 4716 | 92120 | 92139 | TTTTCAAGTTCTACATAGCA | 59 | 2537 |
| 876283 | 5045 | 5064 | 98193 | 98212 | TGTGACATGTAGTTCTTTGG | 38 | 2538 |
| 876307 | 5251 | 5270 | 99257 | 99276 | GTGAAATCTCAAGTAATCGA | 74 | 2539 |
| 876331 | 5651 | 5670 | 101289 | 101308 | ATGGTGAGCCTTGGTTGATC | 57 | 2540 |
| 876355 | 6160 | 6179 | 118493 | 118512 | TGCCGTAGTCAGCAATCTTT | 86 | 2541 |
| 876379 | 6821 | 6840 | 132531 | 132550 | TTTTCTAGGGTATGTCTCTT | 88 | 2542 |
| 876403 | 7579 | 7598 | N/A | N/A | AGCAAGATTGTATCTCTTTC | 78 | 2543 |
| 876427 | 8599 | 8618 | 146768 | 146787 | AATGATGTAGGATCTGCAGC | 65 | 2544 |
| 876451 | N/A | N/A | 3760 | 3779 | AATGAGTTGAAGTGAAAACA | 130 | 2545 |
| 876475 | N/A | N/A | 6080 | 6099 | TATCAACAGATTAACAAAGA | 111 | 2546 |
| 876499 | N/A | N/A | 7975 | 7994 | TTGGTGAAGCAACAGTATCA | 42 | 2547 |
| 876523 | N/A | N/A | 10994 | 11013 | TACAGATGTGCTGAAAGTTA | 112 | 2548 |

TABLE 33-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876547 | N/A | N/A | 14093 | 14112 | TAAAACCAATGTATTGAATG | 84 | 2549 |
| 876571 | N/A | N/A | 16270 | 16289 | ATAACTGTGTTCTACTTTTC | 82 | 2550 |
| 876595 | N/A | N/A | 18575 | 18594 | AGACTTAAAAATGAAAGACA | 106 | 2551 |
| 876619 | N/A | N/A | 20584 | 20603 | AAAATATAAGTCTTAGGGAC | 89 | 2552 |
| 876643 | N/A | N/A | 23603 | 23622 | GTGCCTAAAAAAGAATGTAT | 49 | 2553 |
| 876667 | N/A | N/A | 26400 | 26419 | AGTAGCATTTCCCTGATCAC | 49 | 2554 |
| 876691 | N/A | N/A | 29101 | 29120 | AAAAAAAAACCTAATAGACG | 118 | 2555 |
| 876715 | N/A | N/A | 30926 | 30945 | AAATATCTCTAACAACAATT | 88 | 2556 |
| 876739 | N/A | N/A | 33082 | 33101 | GTAGCCATTTTTTCTAAAAA | 51 | 2557 |
| 876763 | N/A | N/A | 34583 | 34602 | TAATGATTAAGGAATAATTT | 124 | 2558 |
| 876787 | N/A | N/A | 36936 | 36955 | ATCAGAACCATGTTCTCACT | 95 | 2559 |
| 876811 | N/A | N/A | 38784 | 38803 | CTATCATCCTCTGCACCACA | 96 | 2560 |
| 876835 | N/A | N/A | 41037 | 41056 | CCCTCCTCCAACTTTCAGTC | 89 | 2561 |
| 876859 | N/A | N/A | 43022 | 43041 | TATGTCTTTATTCTTAACAT | 67 | 2562 |
| 876883 | N/A | N/A | 47044 | 47063 | TATTCAGCTTTCTTTGCTTT | 93 | 2563 |
| 876907 | N/A | N/A | 48276 | 48295 | GATACTTTTAAATCTAATAG | 116 | 2564 |
| 876931 | N/A | N/A | 50755 | 50774 | CTTCTTTTACCTCCAAACCC | 81 | 2565 |
| 876955 | N/A | N/A | 53306 | 53325 | AATGGTGAATAACCATGCTG | 76 | 2566 |
| 876979 | N/A | N/A | 56534 | 56553 | CCTAAAGGACCCTATTACTT | 99 | 2567 |
| 877003 | N/A | N/A | 59266 | 59285 | CAGTGCCCAGGTGGTAATGA | 73 | 2568 |
| 877027 | N/A | N/A | 61418 | 61437 | TCTCTCAGTCTTCAACCTTC | 93 | 2569 |
| 877051 | N/A | N/A | 63467 | 63486 | ATGTGCAAAACACTAGTATC | 74 | 2570 |
| 877075 | N/A | N/A | 66552 | 66571 | ATTGTCAGGAAGCAAATGAT | 60 | 2571 |
| 877099 | N/A | N/A | 68281 | 68300 | TGAAAAATATGAATACCTCA | 100 | 2572 |
| 877123 | N/A | N/A | 71767 | 71786 | ACAATTTAACTTACCAAGGA | 152 | 2573 |
| 877147 | N/A | N/A | 73109 | 73128 | GATGAAACTGGCACCAAGAA | 100 | 2574 |
| 877171 | N/A | N/A | 74897 | 74916 | GTGGGTCACCTTTCTTTCTT | 43 | 2575 |
| 877195 | N/A | N/A | 77106 | 77125 | ATCAAAGAGGACTCATTAAT | 116 | 2576 |
| 877219 | N/A | N/A | 79825 | 79844 | CAAATCTACCGTTTCTAGGA | 84 | 2577 |
| 877250 | N/A | N/A | 84428 | 84447 | GTTAACTAGTTGCTATATGA | 54 | 2578 |
| 877274 | N/A | N/A | 87487 | 87506 | ACTCGGAAAGTTTCCCAATT | 63 | 2579 |
| 877298 | N/A | N/A | 89963 | 89982 | GAATAGGAAAGTCTACAAAT | 72 | 2580 |
| 877322 | N/A | N/A | 91301 | 91320 | TAATATCCAGAGTGCCGTTA | 52 | 2581 |
| 877346 | N/A | N/A | 93489 | 93508 | CTTAACTAAACCCAAATTCT | 116 | 2582 |
| 877370 | N/A | N/A | 95491 | 95510 | TCAGACAAGTTGCTCTTGGT | 31 | 2583 |
| 877394 | N/A | N/A | 97213 | 97232 | AAGAGGTTTGTATTTAATTT | 68 | 2584 |
| 877418 | N/A | N/A | 100658 | 100677 | CACTTCATAAGTATTGAAGG | 53 | 2585 |
| 877442 | N/A | N/A | 102464 | 102483 | AATAGTTCTCACCACATAAA | 101 | 2586 |
| 877466 | N/A | N/A | 105201 | 105220 | TCTCATATAGTGCCTTGAAA | 65 | 2587 |
| 877490 | N/A | N/A | 107094 | 107113 | AGTCATGTTCAATAAAAATA | 124 | 2588 |
| 877514 | N/A | N/A | 110289 | 110308 | AGGTGGGAATATTCTAAGTA | 48 | 2589 |
| 877538 | N/A | N/A | 112191 | 112210 | CTACAAAAGTTTACCGAGGA | 67 | 2590 |
| 877562 | N/A | N/A | 114372 | 114391 | GAAAGATTCAGATAATCCTT | 130 | 2591 |
| 877586 | N/A | N/A | 117360 | 117379 | ATAATTTCTCACAAGACTTA | 85 | 2592 |
| 877610 | N/A | N/A | 119341 | 119360 | GTAATTTTACTTACAAATAA | 101 | 2593 |
| 877634 | N/A | N/A | 121663 | 121682 | TAAGAGAAATTTATGAATTA | 108 | 2594 |
| 877658 | N/A | N/A | 124138 | 124157 | AACCTAAAGACATCCAATCA | 86 | 2595 |
| 877682 | N/A | N/A | 127082 | 127101 | CAACAGGACCAAATAGGAAT | 78 | 2596 |
| 877706 | N/A | N/A | 130011 | 130030 | GGGACCCTGAGCTAAGACAT | 99 | 2597 |
| 877730 | N/A | N/A | 134153 | 134172 | AAATGGCCTTAATGTTCTCC | 71 | 2598 |
| 877754 | N/A | N/A | 138408 | 138427 | TTTGTGACTCAAAGCTAATA | 76 | 2599 |
| 877778 | N/A | N/A | 140926 | 140945 | CCATTTTCCCTTTTAAACA | 79 | 2600 |
| 877802 | N/A | N/A | 143250 | 143269 | AAGACCATCCATATGACACT | 89 | 2601 |
| 877826 | N/A | N/A | 144863 | 144882 | AACAGCTTAACCTTTCTATA | 88 | 2602 |

TABLE 34

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 44 | 222 |
| 876020 | 528 | 547 | 13794 | 13813 | GAGGAGATCTAAGGTCTTCA | 37 | 2603 |

TABLE 34-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876044 | 830 | 849 | 21661 | 21680 | ATGAGGACTTCCACATTATT | 110 | 2604 |
| 876068 | 1161 | 1180 | 29422 | 29441 | ACAGGCTTCCAGCCAAAACA | 15 | 2605 |
| 876092 | 1473 | 1492 | 35420 | 35439 | TTCAGGAGAATGTATATGCT | 93 | 2606 |
| 876116 | 1637 | 1656 | 37686 | 37705 | ATAAAATGTAAAATAGCTCG | 56 | 2607 |
| 876140 | 2262 | 2281 | 56270 | 56289 | ATTCTGATCACACGCTCTCT | 46 | 2608 |
| 876164 | 2869 | 2888 | 71712 | 71731 | GTAATACGGCATCTCGGTAA | 84 | 2609 |
| 876188 | 3228 | 3247 | 76362 | 76381 | CAAGTCCAAATGTGTCAAAC | 97 | 2610 |
| 876212 | 3800 | 3819 | 82145 | 82164 | CTGATCTGATTATGGCTAAA | 66 | 2611 |
| 876236 | 4144 | 4163 | 86639 | 86658 | TTTTACCACTCCCAGTATTT | 76 | 2612 |
| 876260 | 4725 | 4744 | 92148 | 92167 | CACATTTTACGCTCCGATA | 49 | 2613 |
| 876284 | 5046 | 5065 | 98194 | 98213 | CTGTGACATGTAGTTCTTTG | 65 | 2614 |
| 876308 | 5338 | 5357 | 100190 | 100209 | CTTCAGGACCAATTTAAG | 75 | 2615 |
| 876332 | 5652 | 5671 | 101290 | 101309 | AATGGTGAGCCTTGGTTGAT | 126 | 2616 |
| 876356 | 6204 | 6223 | 118537 | 118556 | GCCCTCTGATGTTTTTATCC | 31 | 2617 |
| 876380 | 6826 | 6845 | 132536 | 132555 | TCATCTTTTCTAGGGTATGT | 38 | 2618 |
| 876404 | 7660 | 7679 | 145829 | 145848 | TTTCAGCTAATTCTTTTCTC | 100 | 2619 |
| 876428 | 8683 | 8702 | 146852 | 146871 | GAAAAGTGTTAGATATTTAT | 34 | 2620 |
| 876452 | N/A | N/A | 3761 | 3780 | GAATGAGTTGAAGTGAAAAC | 53 | 2621 |
| 876476 | N/A | N/A | 6208 | 6227 | ATCCAGTAATCTCATCGCTG | 50 | 2622 |
| 876500 | N/A | N/A | 8095 | 8114 | ATTCTGAACAGCTTCTGGTG | 102 | 2623 |
| 876524 | N/A | N/A | 11128 | 11147 | TTTTCCTGGAAACACATTCT | 71 | 2624 |
| 876548 | N/A | N/A | 14203 | 14222 | AAGGGCAGGAATGACCACTA | 127 | 2625 |
| 876572 | N/A | N/A | 16432 | 16451 | GCAATTGAAGAAAGTCTACT | 81 | 2626 |
| 876596 | N/A | N/A | 18903 | 18922 | GTTTCTCCAGCACCAAGCCC | 126 | 2627 |
| 876620 | N/A | N/A | 20690 | 20709 | TTCCAGAAGGGCAACCAATG | 89 | 2628 |
| 876644 | N/A | N/A | 23667 | 23686 | GAACTGGACAAGTTAATCCT | 57 | 2629 |
| 876668 | N/A | N/A | 26426 | 26445 | TGCTGTTCTAGACAATTTGG | 73 | 2630 |
| 876692 | N/A | N/A | 29204 | 29223 | AAGCCTTGGTCAATTATAAA | 131 | 2631 |
| 876716 | N/A | N/A | 30940 | 30959 | CACTTGCCATTATCAAATAT | 100 | 2632 |
| 876740 | N/A | N/A | 33139 | 33158 | TGTATGCAACCTTGGGACCT | 56 | 2633 |
| 876764 | N/A | N/A | 34714 | 34733 | TGGAAAGCATTTACATAGAA | 97 | 2634 |
| 876788 | N/A | N/A | 36957 | 36976 | TGTTAACTGAAACTTGTGCA | 44 | 2635 |
| 876812 | N/A | N/A | 38785 | 38804 | TCTATCATCCTCTGCACCAC | 52 | 2636 |
| 876836 | N/A | N/A | 41061 | 41080 | TAAGGAAGGCAGCCTTGATA | 42 | 2637 |
| 876860 | N/A | N/A | 43045 | 43064 | TTTATAAAAATGTTCACACT | 31 | 2638 |
| 876884 | N/A | N/A | 47090 | 47109 | AATCTCATCCATCTGTAATT | 80 | 2639 |
| 876908 | N/A | N/A | 48315 | 48334 | TACTCTGATTTCCTCATCTT | 66 | 2640 |
| 876932 | N/A | N/A | 50766 | 50785 | CTTTACAATGTCTTCTTTTA | 103 | 2641 |
| 876956 | N/A | N/A | 53309 | 53328 | ATAAATGGTGAATAACCATG | 140 | 2642 |
| 876980 | N/A | N/A | 56543 | 56562 | TGGATAACACCTAAAGGACC | 39 | 2643 |
| 877004 | N/A | N/A | 59276 | 59295 | GTATTTGGAGCAGTGCCCAG | 52 | 2644 |
| 877028 | N/A | N/A | 61596 | 61615 | GTACCTTAACACAGTAAATA | 104 | 2645 |
| 877052 | N/A | N/A | 63476 | 63495 | TAATCTACTATGTGCAAAAC | 53 | 2646 |
| 877076 | N/A | N/A | 66557 | 66576 | TCTACATTGTCAGGAAGCAA | 51 | 2647 |
| 877100 | N/A | N/A | 68445 | 68464 | ATCTCTCACAGATGCAAAAT | 74 | 2648 |
| 877124 | N/A | N/A | 71781 | 71800 | ATAATCACAATTGCACAATT | 107 | 2649 |
| 877148 | N/A | N/A | 73144 | 73163 | GAATCATTAGGTAAATATAT | 107 | 2650 |
| 877172 | N/A | N/A | 74948 | 74967 | AGTGGAGAAGAGAGAAAGAC | 63 | 2651 |
| 877196 | N/A | N/A | 77137 | 77156 | TATCAAAAACAATTTGCTTT | 143 | 2652 |
| 877220 | N/A | N/A | 79895 | 79914 | ACAGTCTCTTTTCTTATCTG | 74 | 2653 |
| 877232 | N/A | N/A | 81609 | 81628 | TTTAGTGTCAATTCTAAAAA | 101 | 2654 |
| 877251 | N/A | N/A | 84464 | 84483 | CAGTAGCTATAATGCTTTAA | 66 | 2655 |
| 877275 | N/A | N/A | 87627 | 87646 | TTTAGATTTCATTTAAGAAA | 69 | 2656 |
| 877299 | N/A | N/A | 89982 | 90001 | AATTACATGTCCAACAAGAG | 35 | 2657 |
| 877323 | N/A | N/A | 91362 | 91381 | AATAAAAGTATCTTCCAAAC | 76 | 2658 |
| 877347 | N/A | N/A | 93509 | 93528 | AAATTCACAAAAGTTTCTGC | 90 | 2659 |
| 877371 | N/A | N/A | 95698 | 95717 | TTTCATATCTCTTTTATCAT | 77 | 2660 |
| 877395 | N/A | N/A | 97239 | 97258 | TTTTGCTTTGTCAAATTCAC | 41 | 2661 |
| 877419 | N/A | N/A | 100725 | 100744 | CTATAATTGAATATACTATT | 33 | 2662 |
| 877443 | N/A | N/A | 102592 | 102611 | ATTAAATCAATCTAATGCAT | 122 | 2663 |
| 877467 | N/A | N/A | 105313 | 105332 | CTCAATCCCCAAGGAGTTTG | 61 | 2664 |
| 877491 | N/A | N/A | 107115 | 107134 | CTTTCACCCTGAACACACAG | 72 | 2665 |
| 877515 | N/A | N/A | 110361 | 110380 | CTCAACCCTCACCCATGCAG | 100 | 2666 |
| 877539 | N/A | N/A | 112217 | 112236 | CCTGCTTATAATCTCTGGTT | 57 | 2667 |
| 877563 | N/A | N/A | 114595 | 114614 | TCTGAAGGCTTACTATTTTA | 72 | 2668 |
| 877587 | N/A | N/A | 117410 | 117429 | ACTACAGCATTTCATGTGAT | 51 | 2669 |
| 877611 | N/A | N/A | 119355 | 119374 | ATGTATAGCCACCTGTAATT | 47 | 2670 |
| 877635 | N/A | N/A | 121814 | 121833 | CTTGGATAATTATCATAATG | 70 | 2671 |
| 877659 | N/A | N/A | 124271 | 124290 | TCTCTTGGGTTCATGCCTGA | 49 | 2672 |
| 877683 | N/A | N/A | 127120 | 127139 | TAAATATTTTGTAGCTCTA | 47 | 2673 |
| 877707 | N/A | N/A | 130019 | 130038 | TGTTTCTAGGGACCCTGAGC | 66 | 2674 |

TABLE 34-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877731 | N/A | N/A | 134194 | 134213 | AAATGTTGAAATTGTTACAA | 68 | 2675 |
| 877755 | N/A | N/A | 138536 | 138555 | AAATGACAATTAGGAGGGTC | 61 | 2676 |
| 877779 | N/A | N/A | 141131 | 141150 | CTTGCAAAACTTTGTTTCAT | 38 | 2677 |
| 877803 | N/A | N/A | 143288 | 143307 | AATTTATACCAGTCTTATGT | 147 | 2678 |
| 877827 | N/A | N/A | 144888 | 144907 | ATTCTTAATTATGTGAGTCT | 75 | 2679 |

TABLE 35

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 17 | 222 |
| 780624 | N/A | N/A | 81630 87887 | 81649 87906 | GCAGCATCATGCAAGCAGCA | 33 | 674 |
| 876021 | 545 | 564 | N/A | N/A | ATTTTACCTGAAGTTAGGAG | 71 | 2680 |
| 876045 | 831 | 850 | 21662 | 21681 | CATGAGGACTTCCACATTAT | 56 | 2681 |
| 876069 | 1229 | 1248 | 29580 | 29599 | TTATTTAGTGCCCAGCATGC | 61 | 2682 |
| 876093 | 1474 | 1493 | 35421 | 35440 | CTTCAGGAGAATGTATATGC | 41 | 2683 |
| 876117 | 1678 | 1697 | 41911 | 41930 | ATTCTGTATCCTCCCTGGAT | 49 | 2684 |
| 876141 | 2267 | 2286 | 56275 | 56294 | CTGTTATTCTGATCACACGC | 25 | 2685 |
| 876165 | 2870 | 2889 | 71713 | 71732 | TGTAATACGGCATCTCGGTA | 24 | 2686 |
| 876189 | 3229 | 3248 | 76363 | 76382 | GCAAGTCCAAATGTGTCAAA | 30 | 2687 |
| 876213 | 3801 | 3820 | 82146 | 82165 | GCTGATCTGATTATGGCTAA | 24 | 2688 |
| 876237 | 4149 | 4168 | 86644 | 86663 | GGTGGTTTTACCACTCCCAG | 31 | 2689 |
| 876261 | 4727 | 4746 | 92150 | 92169 | GGCACATTTTTACGCTCCGA | 10 | 2690 |
| 876285 | 5048 | 5067 | 98196 | 98215 | TACTGTGACATGTAGTTCTT | 18 | 2691 |
| 876309 | 5343 | 5362 | 100195 | 100214 | ATAAGCTTCAGGAGACCAAT | 51 | 2692 |
| 876333 | 5654 | 5673 | 101292 | 101311 | GGAATGGTGAGCCTTGGTTG | 42 | 2693 |
| 876357 | 6244 | 6263 | 124875 | 124894 | CATTTCCTCTGGCAACTTCA | 55 | 2694 |
| 876381 | 6856 | 6875 | 132566 | 132585 | AATTGCAATACAAACAAGTG | 115 | 2695 |
| 876405 | 7723 | 7742 | 145892 | 145911 | ATAATTTTCCTATCCAAAGA | 108 | 2696 |
| 876429 | 8688 | 8707 | 146857 | 146876 | CAACTGAAAAGTGTTAGATA | 67 | 2697 |
| 876453 | N/A | N/A | 4066 | 4085 | ATACTTGGAATAGTCAAGTC | 73 | 2698 |
| 876477 | N/A | N/A | 6274 | 6293 | TAGCACAGCCATGATGAAAC | 74 | 2699 |
| 876501 | N/A | N/A | 8339 | 8358 | TTGGATCTTTTCCAGATTAA | 48 | 2700 |
| 876525 | N/A | N/A | 11354 | 11373 | AAAAGATTTAAAGTTAATGA | 101 | 2701 |
| 876549 | N/A | V/A | 14435 | 14454 | ACTTCAGTGTTTGTCACTTA | 62 | 2702 |
| 876573 | N/A | N/A | 16563 | 16582 | AATTTCTATGATTTCTGGTG | 57 | 2703 |
| 876597 | N/A | N/A | 19215 | 19234 | ACTGAGCTACTTTTGTCTTC | 65 | 2704 |
| 876621 | N/A | N/A | 20798 | 20817 | TTGGAGAATGACTTTTGCAT | 77 | 2705 |
| 876645 | N/A | N/A | 23873 | 23892 | TGCATTTCTTTATGAAAACA | 26 | 2706 |
| 876669 | N/A | N/A | 26498 | 26517 | AAAGTTACATATGACATGAC | 99 | 2707 |
| 876693 | N/A | N/A | 29206 | 29225 | AGAAGCCTTGGTCAATTATA | 45 | 2708 |
| 876717 | N/A | N/A | 30957 | 30976 | TAACTATCTCAAATTCTCAC | 64 | 2709 |
| 876741 | N/A | N/A | 33365 | 33384 | GATGTCTAACATATCATATT | 39 | 2710 |
| 876765 | N/A | N/A | 34855 | 34874 | TCACTCAGCTTTTTGGGAGT | 60 | 2711 |
| 876789 | N/A | N/A | 37013 | 37032 | TTGACTAGAATGCAGTAGGT | 43 | 2712 |
| 876813 | N/A | N/A | 38806 | 38825 | TGTATCTAGTCTCTCTCCCT | 70 | 2713 |
| 876837 | N/A | N/A | 41246 | 41265 | ATAATGTTTTCCAAACCTAA | 85 | 2714 |
| 876861 | N/A | N/A | 43074 | 43093 | CCATTAATTATTTTAAATAG | 125 | 2715 |
| 876885 | N/A | N/A | 47190 | 47209 | AAATTTCCCTCCAACAAGGT | 78 | 2716 |
| 876909 | N/A | N/A | 48331 | 48350 | ATATTAGAAGTGCAAATACT | 102 | 2717 |
| 876933 | N/A | N/A | 50793 | 50812 | CTTTAAAATCATTCCTTTAC | 143 | 2718 |
| 876957 | N/A | N/A | 53340 | 53359 | TTAGCACATTCTCTGAACTT | 76 | 2719 |
| 876981 | N/A | N/A | 56553 | 56572 | AAGATTAGACTGGATAACAC | 79 | 2720 |
| 877005 | N/A | N/A | 59643 | 59662 | ACATTTAAATAATAATGAAG | 126 | 2721 |
| 877029 | N/A | N/A | 61788 | 61807 | ATCAATGTCAGAATAGCATG | 87 | 2722 |
| 877053 | N/A | N/A | 63610 | 63629 | TGCCAAATTGTCCTCAAAAG | 142 | 2723 |
| 877077 | N/A | N/A | 66573 | 66592 | CTAGAGAAAACATTAATCTA | 125 | 2724 |
| 877101 | N/A | N/A | 68563 | 68582 | AAAATACCTTTACACAAATT | 116 | 2725 |
| 877125 | N/A | N/A | 71841 | 71860 | TTGTTCCTAGCTTTGGCATA | 93 | 2726 |
| 877149 | N/A | N/A | 73151 | 73170 | ATGGAAGGAATCATTAGGTA | 47 | 2727 |

TABLE 35-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877173 | N/A | N/A | 74967 | 74986 | GTATTTAGCAAGGCAAAGAA | 92 | 2728 |
| 877197 | N/A | N/A | 77171 | 77190 | AAAATTGCATAAATTCATATG | 114 | 2729 |
| 877221 | N/A | N/A | 79928 | 79947 | CTGTGAAACACAATTTGGGA | 60 | 2730 |
| 877252 | N/A | N/A | 84473 | 84492 | ACATGATGTCAGTAGCTATA | 41 | 2731 |
| 877276 | N/A | N/A | 87718 | 87737 | TTCACACTAAATGGCCCCTG | 81 | 2732 |
| 877300 | N/A | N/A | 90037 | 90056 | TAATTGGATGAATAAATTTT | 132 | 2733 |
| 877324 | N/A | N/A | 91380 | 91399 | TAAGAGGATAGTTTCTACAA | 57 | 2734 |
| 877348 | N/A | N/A | 93609 | 93628 | TGGCTTGAAAACCAAGTCAT | 86 | 2735 |
| 877372 | N/A | N/A | 95700 | 95719 | TCTTTCATATCTCTTTTATC | 68 | 2736 |
| 877396 | N/A | N/A | 97476 | 97495 | TGATCCTTGTCATGGCAGTT | 36 | 2737 |
| 877420 | N/A | N/A | 100797 | 100816 | AATCAACATTTTCTGAATCT | 84 | 2738 |
| 877444 | N/A | N/A | 102597 | 102616 | TTTATATTAAATCAATCTAA | 120 | 2739 |
| 877468 | N/A | N/A | 105335 | 105354 | AAGAGCTCTGCTACTCCATC | 131 | 2740 |
| 877492 | N/A | N/A | 107501 | 107520 | TAAAGAACTTGAGAAGGTGA | 94 | 2741 |
| 877516 | N/A | N/A | 110418 | 110437 | CCACTGTTAACTAACAGTGT | 144 | 2742 |
| 877540 | N/A | N/A | 112261 | 112280 | CTATAGCCACTACTAATCAG | 109 | 2743 |
| 877564 | N/A | N/A | 114597 | 114616 | ATTCTGAAGGCTTACTATTT | 89 | 2744 |
| 877588 | N/A | N/A | 117435 | 117454 | TTCTCTGCCCCATGATGTCA | 75 | 2745 |
| 877612 | N/A | N/A | 119387 | 119406 | GGTGATTTAATTGAGTTGCA | 45 | 2746 |
| 877636 | N/A | N/A | 121878 | 121897 | TAAATGTTCAATGTATTGTT | 70 | 2747 |
| 877660 | N/A | N/A | 124436 | 124455 | GAGAGATGAGTAGAAAGGAG | 92 | 2748 |
| 877684 | N/A | N/A | 127318 | 127337 | GCACATTATCTTTAATAAAT | 84 | 2749 |
| 877708 | N/A | N/A | 130037 | 130056 | ATAACCCATCTCAGGCTCTG | 62 | 2750 |
| 877732 | N/A | N/A | 134431 | 134450 | CTACTGTGTTCAAGATTTTA | 66 | 2751 |
| 877756 | N/A | N/A | 138860 | 138879 | AGCACAGATGGCAAAAAGCT | 77 | 2752 |
| 877780 | N/A | N/A | 141161 | 141180 | GAAATATTATATCTGTAACT | 85 | 2753 |
| 877804 | N/A | N/A | 143352 | 143371 | AATCTGCTTCTCTTGTGGGA | 68 | 2754 |
| 877828 | N/A | N/A | 145005 | 145024 | CAAATACCTTGGAACTGAAT | 109 | 2755 |

TABLE 36

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 49 | 222 |
| 803643 | N/A | N/A | 81635 87892 | 81654 87911 | TCATTGCAGCATCATGCAAG | 53 | 1805 |
| 876025 | 706 | 725 | 18605 | 18624 | TCTCAACAAATTCAGTCAGT | 55 | 2756 |
| 876049 | 836 | 855 | 21667 | 21686 | CCACTCATGAGGACTTCCAC | 55 | 2757 |
| 876073 | 1235 | 1254 | 29586 | 29605 | AGGAGATTATTTAGTGCCCA | 35 | 2758 |
| 876097 | 1478 | 1497 | 35425 | 35444 | GCCACTTCAGGAGAATGTAT | 39 | 2759 |
| 876121 | 1697 | 1716 | 41930 | 41949 | ATATTTAGCTTATGATGAAA | 93 | 2760 |
| 876145 | 2448 | 2467 | 62069 | 62088 | ACCTTTCCCAATGCTTATCG | 57 | 2761 |
| 876169 | 2890 | 2909 | 71733 | 71752 | GCAAATTTGGTGAGCAACGC | 50 | 2762 |
| 876193 | 3294 | 3313 | 76428 | 76447 | ATCAAGATTAGCAATACAAC | 105 | 2763 |
| 876217 | 3807 | 3826 | 82152 | 82171 | CAAGATGCTGATCTGATTAT | 64 | 2764 |
| 876241 | 4309 | 4328 | 87213 | 87232 | TATAGAATTCCTCACGACCT | 85 | 2765 |
| 876265 | 4732 | 4751 | 92155 | 92174 | CAATTGGCACATTTTTACGC | 79 | 2766 |
| 876289 | 5053 | 5072 | 98201 | 98220 | TAAAATACTGTGACATGTAG | 39 | 2767 |
| 876313 | 5446 | 5465 | 100435 | 100454 | CCACAACTTGGCCCAAAAGA | 68 | 2768 |
| 876337 | 5691 | 5710 | 101329 | 101348 | GTCAGCCAAAATCAAGTCAG | 48 | 2769 |
| 876361 | 6380 | 6399 | 125011 | 125030 | GGTAATTTTCCTTGTATTTC | 57 | 2770 |
| 876385 | 6998 | 7017 | 137402 | 137421 | GGAGTACTGACATTTCCTAT | 46 | 2771 |
| 876409 | 7903 | 7922 | 146072 | 146091 | ATAAGAAATATAACATTGTG | 99 | 2772 |
| 876433 | 8823 | 8842 | 146992 | 147011 | CCTCAAATTATTACATAGGT | 60 | 2773 |
| 876457 | N/A | N/A | 4255 | 4274 | TAAGACATCACTTTCTTTAG | 58 | 2774 |
| 876481 | N/A | N/A | 6920 | 6939 | GAATCAAATATTGGCTGTGC | 115 | 2775 |
| 876505 | N/A | N/A | 8749 | 8768 | CATATATGTACCCTCTAGAG | 88 | 2776 |
| 876529 | N/A | N/A | 11687 | 11706 | CTGATACATAGAATTACAGA | 70 | 2777 |
| 876553 | N/A | N/A | 14518 | 14537 | GCCAAAGTTTTCTCAGGGAA | 54 | 2778 |
| 876577 | N/A | N/A | 16867 | 16886 | GGGCCCACATAAATCATTCT | 113 | 2779 |
| 876601 | N/A | N/A | 19369 | 19388 | CTCTCCACTCCATGTCTCTG | 75 | 2780 |

TABLE 36-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876625 | N/A | N/A | 21104 | 21123 | ACAATAATGTAACATATTTT | 94 | 2781 |
| 876649 | N/A | N/A | 24272 | 24291 | AGCAAACATTTAAAAGCCCA | 52 | 2782 |
| 876673 | N/A | N/A | 26747 | 26766 | CATAATTAGATTACATAGTT | 110 | 2783 |
| 876697 | N/A | N/A | 29480 | 29499 | TTTATGAGAGTCCTACCTGC | 131 | 2784 |
| 876721 | N/A | N/A | 31326 | 31345 | TAGAAGTCCGGAAAAATATA | 106 | 2785 |
| 876745 | N/A | N/A | 33421 | 33440 | TCTTACTCAATAGTCACCTT | 72 | 2786 |
| 876769 | N/A | N/A | 35273 | 35292 | TTAGAATATTAATATAGTCC | 44 | 2787 |
| 876793 | N/A | N/A | 37536 | 37555 | ACTGATCTGATTCAATGGTA | 96 | 2788 |
| 876817 | N/A | N/A | 38963 | 38982 | CAGAACAAAGTATCATCCCT | 88 | 2789 |
| 876841 | N/A | N/A | 41339 | 41358 | CTTTATTAAGCTACACTGTA | 82 | 2790 |
| 876865 | N/A | N/A | 43282 | 43301 | AGATAAATTTAACCCATTAC | 95 | 2791 |
| 876889 | N/A | N/A | 47322 | 47341 | ACGAATCATGCCACAGTGAA | 95 | 2792 |
| 876913 | N/A | N/A | 48676 | 48695 | TACTAGAACACAGTGAAATG | 119 | 2793 |
| 876937 | N/A | N/A | 51449 | 51468 | AATACATAGTCTCCCTTGAC | 95 | 2794 |
| 876961 | N/A | N/A | 53597 | 53616 | ATTCTTAATCTCCCGTGAAC | 74 | 2795 |
| 876985 | N/A | N/A | 56874 | 56893 | CATGGTTCAGGAGGGAAGAG | 107 | 2796 |
| 877009 | N/A | N/A | 59869 | 59888 | TCCTTGGAGGATCCAAACTA | 99 | 2797 |
| 877033 | N/A | N/A | 62406 | 62425 | TCATAAAGAACTTAAATGTC | 135 | 2798 |
| 877057 | N/A | N/A | 64411 | 64430 | ATGGGAAATTATCCCGAAGC | 133 | 2799 |
| 877081 | N/A | N/A | 66847 | 66866 | CAAAATACTTCAACACTTCA | 119 | 2800 |
| 877105 | N/A | N/A | 68855 | 68874 | AATATAACAAAAATCTGATT | 126 | 2801 |
| 877129 | N/A | N/A | 72099 | 72118 | AACCCACACCATTAGGTAGA | 90 | 2802 |
| 877153 | N/A | N/A | 73877 | 73896 | TGCAAAAACCAGAGGCACGG | 78 | 2803 |
| 877177 | N/A | N/A | 75128 | 75147 | TTTTAAATCAAATTGGATGA | 143 | 2804 |
| 877201 | N/A | N/A | 77744 | 77763 | CCCCTCTATAGTATACAAAA | 94 | 2805 |
| 877225 | N/A | N/A | 80668 | 80687 | TTAACCTGGAAGCTAAACAG | 149 | 2806 |
| 877256 | N/A | N/A | 84735 | 84754 | TGAGAGGTGATGACAGAGCT | 99 | 2807 |
| 877280 | N/A | N/A | 87905 | 87924 | TGCACAGAAGAGTTCATTGC | 86 | 2808 |
| 877304 | N/A | N/A | 90343 | 90362 | TAAAAAGTTGTCTTCAAAGG | 87 | 2809 |
| 877328 | N/A | N/A | 91620 | 91639 | CTTGGTTATTTGTAAAATGT | 37 | 2810 |
| 877352 | N/A | N/A | 93973 | 93992 | TTATGTCAAAGCTACAGAGA | 60 | 2811 |
| 877376 | N/A | N/A | 95796 | 95815 | TTTTCCAAATTCCTTTGTAT | 58 | 2812 |
| 877400 | N/A | N/A | 97827 | 97846 | GAAACAATGAACATCAGTAT | 80 | 2813 |
| 877424 | N/A | N/A | 101020 | 101039 | AACTGCTGCAGACTACCAGA | 82 | 2814 |
| 877448 | N/A | N/A | 102830 | 102849 | AGCATTTAAATTCAACCTAA | 133 | 2815 |
| 877472 | N/A | N/A | 105422 | 105441 | GTAAGGTTGAGAACAAGTGC | 80 | 2816 |
| 877496 | N/A | N/A | 108081 | 108100 | AGTAGATTCTGTTATACAAA | 53 | 2817 |
| 877520 | N/A | N/A | 110838 | 110857 | AAAAGAGATTATGTCAGATT | 86 | 2818 |
| 877544 | N/A | N/A | 112426 | 112445 | GTACTGTCAGAATTAAATTT | 76 | 2819 |
| 877568 | N/A | N/A | 115091 | 115110 | GATTTGTTATTTAAAGTAAG | 166 | 2820 |
| 877592 | N/A | N/A | 117565 | 117584 | ACAGTGTAAAGTTTTCATCT | 58 | 2821 |
| 877616 | N/A | N/A | 119914 | 119933 | GAGTTGCATATGGTTTAGGA | 36 | 2822 |
| 877640 | N/A | N/A | 122283 | 122302 | TTCTCATCCAGTGCACACAT | 81 | 2823 |
| 877664 | N/A | N/A | 124843 | 124862 | CCTGAAAGTAAGCAGATAAA | 141 | 2824 |
| 877688 | N/A | N/A | 127923 | 127942 | AATTCATGCCATTCCAGAAT | 143 | 2825 |
| 877712 | N/A | N/A | 132134 | 132153 | ATAAGAAGATTGTTCCTCTC | 84 | 2826 |
| 877736 | N/A | N/A | 135027 | 135046 | AGAGAAATAAATGCTCATGG | 82 | 2827 |
| 877760 | N/A | N/A | 139725 | 139744 | TATGGAACTTTAAAGAGTTA | 93 | 2828 |
| 877784 | N/A | N/A | 141305 | 141324 | ACTTTACTTACTTTTGGTTA | 81 | 2829 |
| 877808 | N/A | N/A | 143492 | 143511 | AGACTATGATTAAAACAAAC | 88 | 2830 |
| 877832 | N/A | N/A | 145211 | 145230 | ACATCATTGCCCTGTTTGGA | 55 | 2831 |

TABLE 37

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 34 | 222 |
| 876026 | 711 | 730 | 18610 | 18629 | TTTGTTCTCAACAAATTCAG | 45 | 2832 |
| 876050 | 837 | 856 | 21668 | 21687 | GCCACTCATGAGGACTTCCA | 25 | 2833 |
| 876074 | 1236 | 1255 | 29587 | 29606 | AAGGAGATTATTAGTGCCC | 41 | 2834 |
| 876098 | 1480 | 1499 | 35427 | 35446 | CAGCCACTTCAGGAGAATGT | 33 | 2835 |

TABLE 37-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876122 | 1698 | 1717 | 41931 | 41950 | CATATTTAGCTTATGATGAA | 66 | 2836 |
| 876146 | 2449 | 2468 | 62070 | 62089 | CACCTTTCCCAATGCTTATC | 44 | 2837 |
| 876170 | 2931 | 2950 | 72955 | 72974 | TTCATGATCAAAAATGGGCC | 44 | 2838 |
| 876194 | 3333 | 3352 | 76467 | 76486 | ATCTAAAACCACTGAGGGTC | 59 | 2839 |
| 876218 | 3835 | 3854 | 82180 | 82199 | ACCATAAATATGCTTTTTCA | 36 | 2840 |
| 876242 | 4311 | 4330 | 87215 | 87234 | ACTATAGAATTCCTCACGAC | 45 | 2841 |
| 876266 | 4733 | 4752 | 92156 | 92175 | TCAATTGGCACATTTTTACG | 71 | 2842 |
| 876290 | 5067 | 5086 | 98215 | 98234 | TTTTTCTAGGAGCTTAAAAT | 90 | 2843 |
| 876314 | 5447 | 5466 | 100436 | 100455 | TCCACAACTTGGCCCAAAAG | 75 | 2844 |
| 876338 | 5692 | 5711 | 101330 | 101349 | GGTCAGCCAAAATCAAGTCA | 76 | 2845 |
| 876362 | 6427 | 6446 | 126543 | 126562 | TCTCAACCATAGGCCATGGG | 36 | 89 |
| 876386 | 7041 | 7060 | 137445 | 137464 | ATTTCTTTCCGTTGAATTTG | 71 | 2846 |
| 876410 | 7993 | 8012 | 146162 | 146181 | ATCGGCCTTATAAATTTTAG | 56 | 2847 |
| 876434 | 8862 | 8881 | 147031 | 147050 | AAGAATTTACCGAAAGTACT | 88 | 2848 |
| 876458 | N/A | N/A | 4345 | 4364 | AAATTTCTGGGTTTCCTATG | 78 | 2849 |
| 876482 | N/A | N/A | 7014 | 7033 | AGCTCTTTGATCCTCAGTGA | 43 | 2850 |
| 876506 | N/A | N/A | 8763 | 8782 | AAAAAGAGAAAGTGCATATA | 97 | 2851 |
| 876530 | N/A | N/A | 11858 | 11877 | TGTACAGGAATATGACTAGA | 73 | 2852 |
| 876554 | N/A | N/A | 14745 | 14764 | TCCAGCCTCTCTCATGCTAT | 94 | 2853 |
| 876578 | N/A | N/A | 16881 | 16900 | TGATAACTGACACAGGGCCC | 91 | 2854 |
| 876602 | N/A | N/A | 19380 | 19399 | GGCCCTTCATGCTCTCCACT | 81 | 2855 |
| 876626 | N/A | N/A | 21285 | 21304 | AGATAAATAAATTGGAGGGT | 76 | 2856 |
| 876650 | N/A | N/A | 24302 | 24321 | ATATTTTTAAGCCCACATTG | 83 | 2857 |
| 876674 | N/A | N/A | 27099 | 27118 | TCATCAACGGCCTCACAATC | 114 | 2858 |
| 876698 | N/A | N/A | 29500 | 29519 | AATTTTGAATAACTCTAATA | 115 | 2859 |
| 876722 | N/A | N/A | 31348 | 31367 | ATGTCATGTGTGAGTTTACA | 46 | 2860 |
| 876746 | N/A | N/A | 33423 | 33442 | GGTCTTACTCAATAGTCACC | 55 | 2861 |
| 876770 | N/A | N/A | 35317 | 35336 | ACTTATAGATATGAAAGCAT | 86 | 2862 |
| 876794 | N/A | N/A | 37818 | 37837 | AAAGATTTACATTTAGTCGA | 67 | 2863 |
| 876818 | N/A | N/A | 39048 | 39067 | ATATAACTAGAGAAAATGAT | 118 | 2864 |
| 876842 | N/A | N/A | 41389 | 41408 | AAGTTCTGTAAAGGCTATAT | 65 | 2865 |
| 876866 | N/A | N/A | 43424 | 43443 | AAAGAAAAGAACCAAGGTTT | 67 | 2866 |
| 876890 | N/A | N/A | 47351 | 47370 | GCATTTAGTTTGTTGCCACA | 30 | 2867 |
| 876914 | N/A | N/A | 48782 | 48801 | CTAATAAAGTGGATGGATTT | 117 | 2868 |
| 876938 | N/A | N/A | 51461 | 51480 | TATCATCTTAATAATACATA | 66 | 2869 |
| 876962 | N/A | N/A | 53654 | 53673 | CTCTTGAAGAAAAACTATTT | 96 | 2870 |
| 876986 | N/A | N/A | 56900 | 56919 | AGAACAATCAGATAGATATA | 105 | 2871 |
| 877010 | N/A | N/A | 59885 | 59904 | TTTGTGGAAGGAATTTTCCT | 73 | 2872 |
| 877034 | N/A | N/A | 62466 | 62485 | GTACCCCTTCAAAAAGCTTC | 97 | 2873 |
| 877058 | N/A | N/A | 64464 | 64483 | CACTATACCCATATACCCAA | 84 | 2874 |
| 877082 | N/A | N/A | 67017 | 67036 | GAAAACTGCATTTCACCAAG | 67 | 2875 |
| 877106 | N/A | N/A | 69629 | 69648 | TTATCCAGAAAATCTCCAAA | 99 | 2876 |
| 877130 | N/A | N/A | 72373 | 72392 | TCCATAGTTCCAAAACAGAC | 76 | 2877 |
| 877154 | N/A | N/A | 73916 | 73935 | CAAAGATGCTCCTGAACATC | 87 | 2878 |
| 877178 | N/A | N/A | 75204 | 75223 | CACTGGGAATAGACAGAAAC | 68 | 2879 |
| 877202 | N/A | N/A | 77774 | 77793 | GGTTTTGACAAGTGTACCAT | 57 | 2880 |
| 877226 | N/A | N/A | 80802 | 80821 | ACCAATAGTGTGTCACTTAA | 48 | 2881 |
| 877233 | N/A | N/A | 81930 | 81949 | ACTAGCATTATTGACATATG | 98 | 2882 |
| 877257 | N/A | N/A | 84787 | 84806 | TAGTGAGTGAACACAGCCAT | 48 | 2883 |
| 877281 | N/A | N/A | 87933 | 87952 | TCCTGACACAAGCTTTTTAA | 64 | 2884 |
| 877305 | N/A | N/A | 90378 | 90397 | CTGGTATTTCTCAAAGCATT | 40 | 2885 |
| 877329 | N/A | N/A | 91655 | 91674 | TTTTAAATATTCAAGGTAAA | 96 | 2886 |
| 877353 | N/A | N/A | 94061 | 94080 | AATGTGCAACAAAGAATTAT | 74 | 2887 |
| 877377 | N/A | N/A | 95892 | 95911 | CATTATCTTGACTTTATCAC | 78 | 2888 |
| 877401 | N/A | N/A | 98295 | 98314 | TAGCAATTAATTTTTTAAGG | 95 | 2889 |
| 877425 | N/A | N/A | 101246 | 101265 | AGAAGTAATAAAACATTTTT | 140 | 2890 |
| 877449 | N/A | N/A | 103447 | 103466 | GGGAGAGTAATCACAAACAT | 76 | 2891 |
| 877473 | N/A | N/A | 105724 | 105743 | TCTCCTGTTCAGAAACAAAT | 103 | 2892 |
| 877497 | N/A | N/A | 108130 | 108149 | GTTTAGAGCAGTAAGTCATG | 65 | 2893 |
| 877521 | N/A | N/A | 110906 | 110925 | TAAAATTTGAAATGCATGCT | 118 | 2894 |
| 877545 | N/A | N/A | 112696 | 112715 | TACTTAACGAAGATTAAATA | 106 | 2895 |
| 877569 | N/A | N/A | 115659 | 115678 | CAAATGCATACTTGCTTTCG | 71 | 2896 |
| 877593 | N/A | N/A | 117566 | 117585 | AACAGTGTAAAGTTTTCATC | 65 | 2897 |
| 877617 | N/A | N/A | 119915 | 119934 | AGAGTTGCATATGGTTTAGG | 39 | 2898 |
| 877641 | N/A | N/A | 122290 | 122309 | TTCTAAATTCTCATCCAGTG | 61 | 2899 |
| 877665 | N/A | N/A | 125117 | 125136 | ATGATCATCTGTTTAAGGAA | 74 | 2900 |
| 877689 | N/A | N/A | 128242 | 128261 | AGCATAAACAAGAAGGAGAA | 80 | 2901 |
| 877713 | N/A | N/A | 132213 | 132232 | AGTTTTGCCTATCAAGATGA | 82 | 2902 |
| 877737 | N/A | N/A | 135443 | 135462 | CCTAAGCACCCATGAATGAA | 79 | 2903 |
| 877761 | N/A | N/A | 139807 | 139826 | AATCTCTTTTGGGAGATGAG | 81 | 2904 |
| 877785 | N/A | N/A | 141341 | 141360 | TAACCATTCTGAATTGAATA | 86 | 2905 |

TABLE 37-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877809 | N/A | N/A | 143723 | 143742 | AATTATTATCAAAGGAAGAC | 126 | 2906 |
| 877833 | N/A | N/A | 145245 | 145264 | AATTTATGAAACACATAATA | 101 | 2907 |

TABLE 38

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 15 | 222 |
| 803630 | N/A | N/A | 81592 87849 | 81611 87868 | AAAGCCATAGTGTTTGAAGG | 66 | 1792 |
| 876015 | 341 | 360 | 3732 | 3751 | ACCTGCTGCACACTCGCGAC | 39 | 2908 |
| 876039 | 824 | 843 | N/A | N/A | ACTTCCACATTATTGCAAGG | 38 | 2909 |
| 876063 | 1038 | 1057 | 28013 | 28032 | CGCTGAGATCTGCAATGCTG | 66 | 2910 |
| 876087 | 1467 | 1486 | 35414 | 35433 | AGAATGTATATGCTTCTGCA | 75 | 2911 |
| 876111 | 1499 | 1518 | 35446 | 35465 | AGCATTTTACAGCCACTTTC | 50 | 2912 |
| 876135 | 2086 | 2105 | 56020 | 56039 | AAGATGCTGACAATTTGAGG | 66 | 2913 |
| 876159 | 2716 | 2735 | 65554 | 65573 | ATTTAGACAGCACATCTTCA | 76 | 2914 |
| 876183 | 3222 | 3241 | 76356 | 76375 | CAAATGTGTCAAACTCTTCA | 42 | 2915 |
| 876207 | 3752 | 3771 | 82097 | 82116 | CAGTGTGCGGGACCTGGTAG | 52 | 2916 |
| 876231 | 3973 | 3992 | 83968 | 83987 | ATTTCCCCATTTCATTGGGA | 74 | 2917 |
| 876255 | 4604 | 4623 | 88705 | 88724 | CGAAGTTTTGCCAAAGCATC | 37 | 2918 |
| 876279 | 4962 | 4981 | 98110 | 98129 | TTTTGGACAACCTTCCACTT | 51 | 2919 |
| 876303 | 5197 | 5216 | 99203 | 99222 | AAGGCATTTCATATAGTCGG | 31 | 2920 |
| 876327 | 5646 | 5665 | 101284 | 101303 | GAGCCTTGGTTGATCTGGAT | 41 | 2921 |
| 876351 | 6067 | 6086 | N/A | N/A | TGGCTGAGTGGAGGTATCTC | 100 | 2922 |
| 876375 | 6733 | 6752 | 132443 | 132462 | TTTCAACAGGAAGATGCACC | 68 | 2923 |
| 876399 | 7490 | 7509 | 143138 | 143157 | AGCTGTGCTGTCATCATGAC | 77 | 2924 |
| 876423 | 8494 | 8513 | 146663 | 146682 | AAAAATATCACTTGAAGGAC | 76 | 2925 |
| 876447 | N/A | N/A | 3735 | 3754 | TTTACCTGCTGCACACTCGC | 44 | 2926 |
| 876471 | N/A | N/A | 5332 | 5351 | TATACATGTATCAAATAGCA | 56 | 2927 |
| 876495 | N/A | N/A | 7824 | 7843 | ATCTCTCTAAGAGAGAAGGT | 110 | 2928 |
| 876519 | N/A | N/A | 10780 | 10799 | TCTCTTCATGGTTTGAATTC | 72 | 2929 |
| 876543 | N/A | N/A | 13667 | 13686 | AAGTTTGCTTATTTGCATTT | 75 | 2930 |
| 876567 | N/A | N/A | 15828 | 15847 | TAATTTCATGAGTCTCAATC | 89 | 2931 |
| 876591 | N/A | N/A | 17978 | 17997 | CATGTATAAAATTATAGTTT | 72 | 2932 |
| 876615 | N/A | N/A | 20147 | 20166 | CAATGTGGGTGGAAAACAAT | 107 | 2933 |
| 876639 | N/A | N/A | 23039 | 23058 | ATAGACAATGACCCTTGCTC | 38 | 2934 |
| 876663 | N/A | N/A | 26161 | 26180 | TTCTCATGAAAAATAATGAA | 80 | 2935 |
| 876687 | N/A | N/A | 28159 | 28178 | TGAGCTACACAGGACAGAAA | 90 | 2936 |
| 876711 | N/A | N/A | 30793 | 30812 | CAAAAGCATATGCAGCAGAG | 47 | 2937 |
| 876735 | N/A | N/A | 32754 | 32773 | ATCAAAGGAGATTTCCAGGT | 33 | 2938 |
| 876759 | N/A | N/A | 34066 | 34085 | AATAAGTAGTCTATCTTAAG | 101 | 2939 |
| 876783 | N/A | N/A | 36564 | 36583 | TCCGCTGTGTTTTTGCCTCA | 65 | 2940 |
| 876807 | N/A | N/A | 38580 | 38599 | ATGCCTCACTCACCCCCGAC | 70 | 2941 |
| 876831 | N/A | N/A | 40880 | 40899 | AAGAAGATGTGACCACTAAA | 122 | 2942 |
| 876855 | N/A | N/A | 42917 | 42936 | GTAATTCCCTTCTTCTCTTT | 47 | 2943 |
| 876879 | N/A | N/A | 46712 | 46731 | AATACTATTGTTATTTTAC | 126 | 2944 |
| 876903 | N/A | N/A | 48099 | 48118 | CAGGGTGCATAGTCTGTAGG | 49 | 2945 |
| 876927 | N/A | N/A | 50346 | 50365 | TCTGAACTTTCTGTTTGATT | 35 | 2946 |
| 876951 | N/A | N/A | 52863 | 52882 | GCCCTACAAAAATCTATTCT | 53 | 2947 |
| 876975 | N/A | N/A | 56130 | 56149 | GGATGCAAGTGAAAAACACT | 103 | 2948 |
| 876999 | N/A | N/A | 57946 | 57965 | CTAGATATAAATAACCTCTG | 52 | 2949 |
| 877023 | N/A | N/A | 61194 | 61213 | ATAATATCCATCAGTTACTG | 97 | 2950 |
| 877047 | N/A | N/A | 63254 | 63273 | GAAGAGACAGCCAGGTGAAG | 126 | 2951 |
| 877071 | N/A | N/A | 66298 | 66317 | ACAATATTTTGGAACAACTC | 51 | 2952 |
| 877095 | N/A | N/A | 67597 | 67616 | ATAGGTAATATGATTTAATT | 127 | 2953 |
| 877119 | N/A | N/A | 71046 | 71065 | TCATGTTTCATGGTTTCTTT | 31 | 2954 |
| 877143 | N/A | N/A | 72871 | 72890 | GGAAGGAACCATGAAATTTT | 74 | 2955 |
| 877167 | N/A | N/A | 74441 | 74460 | CCTTGAGAATTTAACAATTT | 44 | 2956 |
| 877191 | N/A | N/A | 76594 | 76613 | CTCTTTCTTACCCTTCTAAA | 143 | 2957 |
| 877215 | N/A | N/A | 79222 | 79241 | GCAAAGCAAACAGATTTTGA | 49 | 2958 |

TABLE 38-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877246 | N/A | N/A | 83653 | 83672 | TCACTCATCTGTAATATTAA | 34 | 2959 |
| 877270 | N/A | N/A | 86973 | 86992 | CTAACATATCCCTCCATGTT | 69 | 2960 |
| 877294 | N/A | N/A | 89174 | 89193 | CCATAAAACAGGAATTCCAA | 84 | 2961 |
| 877318 | N/A | N/A | 91036 | 91055 | ATCTCTTAACCCAGAGAATT | 93 | 2962 |
| 877342 | N/A | N/A | 93085 | 93104 | ATATTTGAGACACTGACATG | 107 | 2963 |
| 877366 | N/A | N/A | 95216 | 95235 | AATTACTCCACAGAATCTTC | 104 | 2964 |
| 877390 | N/A | N/A | 96680 | 96699 | AATTCTAACTCTACCTCTTC | 140 | 2965 |
| 877414 | N/A | N/A | 99835 | 99854 | TAAAAAGAAGTTTTTGATCA | 100 | 2966 |
| 877438 | N/A | N/A | 102077 | 102096 | ATGTGCAGGAAGTCAAGATA | 63 | 2967 |
| 877462 | N/A | N/A | 104952 | 104971 | GTATTATTTGCATCTTATCA | 57 | 2968 |
| 877486 | N/A | N/A | 106807 | 106826 | AGTGAGTCTTACAAAAAGTT | 73 | 2969 |
| 877510 | N/A | N/A | 110180 | 110199 | GAGAAAAGCACAGATGACTC | 46 | 2970 |
| 877534 | N/A | N/A | 111786 | 111805 | CTCTGCAATTCAAAAAAAGT | 100 | 2971 |
| 877558 | N/A | N/A | 114104 | 114123 | TAGGCAATGAGAGATGATAC | 147 | 2972 |
| 877582 | N/A | N/A | 117147 | 117166 | CAGCTGAAGATTCTCTCTCT | 66 | 2973 |
| 877606 | N/A | N/A | 119182 | 119201 | TCAGGATTGGGAACTAAGAA | 56 | 2974 |
| 877630 | N/A | N/A | 121116 | 121135 | TTCTCTAAACTTTAGTCTCT | 53 | 2975 |
| 877654 | N/A | N/A | 123425 | 123444 | TACTCTTTCAACTGTTCTTT | 61 | 2976 |
| 877678 | N/A | N/A | 126753 | 126772 | GGATGGTGAAAATTATAGGA | 61 | 2977 |
| 877702 | N/A | N/A | 129321 | 129340 | TTCTATATTGCAGAGCCACC | 131 | 2978 |
| 877726 | N/A | N/A | 133413 | 133432 | TTCAGTGGAGTTTAGTTCAG | 81 | 2979 |
| 877750 | N/A | N/A | 138222 | 138241 | CCAAGTTCACAAAACCAATA | 57 | 2980 |
| 877774 | N/A | N/A | 140803 | 140822 | ATGGCAAACTCCTACTTGGC | 97 | 2981 |
| 877798 | N/A | N/A | 142508 | 142527 | TTTTCCCAGAACCAGTGAAT | 102 | 2982 |
| 877822 | N/A | N/A | 144769 | 144788 | TTTGGATATGGTAAGGTACA | 71 | 2983 |

TABLE 39

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 18 | 222 |
| 803628 | N/A | N/A | 81589 87846 | 81608 87865 | GCCATAGTGTTTGAAGGAAT | 43 | 1790 |
| 876012 | 338 | 357 | 3729 | 3748 | TGCTGCACACTCGCGACTCT | 71 | 2984 |
| 876036 | 802 | 821 | 18701 | 18720 | TCGCTAGGGAATGTAAACAA | 63 | 2985 |
| 876060 | 877 | 896 | 21708 | 21727 | CTTTCATAGCTTCCACCACA | 56 | 2986 |
| 876084 | 1450 | 1469 | 35397 | 35416 | GCATTAACTCCAAAACATTC | 32 | 2987 |
| 876108 | 1491 | 1510 | 35438 | 35457 | ACAGCCACTTTCAGCCACTT | 63 | 2988 |
| 876132 | 1957 | 1976 | 52997 | 53016 | CATTCTTCTTTGTAATCAAG | 53 | 2989 |
| 876156 | 2621 | 2640 | N/A | N/A | GCTAGTGTAGATGCTATATT | 26 | 2990 |
| 876180 | 3215 | 3234 | N/A | N/A | GTCAAACTCTTCAGAGTTTC | 21 | 2991 |
| 876204 | 3660 | 3679 | 80940 | 80959 | GGAAAATTTGTTCTGAGATA | 20 | 2992 |
| 876228 | 3924 | 3943 | 83919 | 83938 | ATCCAGAGATGTCAGATTTT | 131 | 2993 |
| 876252 | 4427 | 4446 | N/A | N/A | GCGCGAGCCTTTATATTGAA | 95 | 2994 |
| 876276 | 4816 | 4835 | 92239 | 92258 | CGTGAGGAAGCTCATTTTCA | 30 | 148 |
| 876300 | 5193 | 5212 | 99199 | 99218 | CATTTCATATAGTCGGATGA | 46 | 2995 |
| 876324 | 5571 | 5590 | 100560 | 100579 | TTGATGTTCTTCACCATCAT | 57 | 2996 |
| 876348 | 5984 | 6003 | 113181 | 113200 | TGCTGAAGCAGGCGATCCAA | 97 | 2997 |
| 876372 | 6650 | 6669 | 129795 | 129814 | TCAAGAAATGAGAGCTGTCC | 87 | 2998 |
| 876396 | 7395 | 7414 | 143043 | 143062 | TCCTCCAGTTCCTATCCAAA | 87 | 2999 |
| 876420 | 8397 | 8416 | 146566 | 146585 | ATGTCTAGGAAAGACACAGA | 119 | 3000 |
| 876444 | 9175 | 9194 | 147344 | 147363 | ATTTAAATATGGTATTCATT | 145 | 3001 |
| 876468 | N/A | N/A | 5184 | 5203 | ACTCATAACTACTCCGGACA | 101 | 3002 |
| 876492 | N/A | N/A | 7482 | 7501 | TGGCAGTCTGGAATATCATG | 62 | 3003 |

TABLE 39-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876516 | N/A | N/A | 10656 | 10675 | AATCAAACTTCTGAGTTTAA | 78 | 3004 |
| 876540 | N/A | N/A | 13053 | 13072 | AGCACTACTTATTTTCCAAT | 34 | 3005 |
| 876564 | N/A | N/A | 15510 | 15529 | AGGCACCTTCATTCCTATTG | 63 | 3006 |
| 876588 | N/A | N/A | 17889 | 17908 | TTTTAATTTTATGCCAGAGT | 42 | 3007 |
| 876612 | N/A | N/A | 19937 | 19956 | TTGTGATTTTATAAACATCA | 72 | 3008 |
| 876636 | N/A | N/A | 22628 | 22647 | TTAACCCTTATTTATATATG | 104 | 3009 |
| 876660 | N/A | N/A | 25657 | 25676 | TTATATACATCTGTGTATAA | 85 | 3010 |
|  |  |  | 25687 | 25706 |  |  |  |
|  |  |  | 25717 | 25736 |  |  |  |
|  |  |  | 25747 | 25766 |  |  |  |
|  |  |  | 25811 | 25830 |  |  |  |
|  |  |  | 25875 | 25894 |  |  |  |
| 876684 | N/A | N/A | 27860 | 27879 | TTAACATATAACACTATTTA | 119 | 3011 |
| 876708 | N/A | N/A | 30296 | 30315 | CAGAGGATACCCATTGCAAA | 60 | 3012 |
| 876732 | N/A | N/A | 32607 | 32626 | CCTCTTTAACTGCACAGTAG | 38 | 3013 |
| 876756 | N/A | N/A | 33886 | 33905 | AACCTTTCCCAAAGTGGCTA | 56 | 3014 |
| 876780 | N/A | N/A | 36392 | 36411 | TAACCCTACTTCTTACAAGT | 109 | 3015 |
| 876804 | N/A | N/A | 38436 | 38455 | CATCGATATTCTCAAAGCCT | 45 | 3016 |
| 876828 | N/A | N/A | 40375 | 40394 | TACTTAAAATACTTCAAACA | 110 | 3017 |
| 876852 | N/A | N/A | 42387 | 42406 | ACCATATACTATGAGACCAG | 40 | 3018 |
| 876876 | N/A | N/A | 45845 | 45864 | GGAATTACAGTGGAGAGGTT | 107 | 3019 |
| 876900 | N/A | N/A | 48095 | 48114 | GTGCATAGTCTGTAGGTAGT | 28 | 3020 |
| 876924 | N/A | N/A | 50233 | 50252 | GCTCTGTTGTCACCCTTGTA | 62 | 3021 |
| 876948 | N/A | N/A | 52394 | 52413 | CATTAGAAGATGAATTCACT | 104 | 3022 |
| 876972 | N/A | N/A | 55581 | 55600 | ATAATATTGAACAGTAGGTT | 84 | 3023 |
| 876996 | N/A | N/A | 57799 | 57818 | CTGTTGGGTAGAAAGATTTG | 85 | 3024 |
| 877020 | N/A | N/A | 60838 | 60857 | GGTTGGAAGGCACCAATTAA | 76 | 3025 |
| 877044 | N/A | N/A | 63123 | 63142 | AGCCTACTGAGCGGTTGGAA | 82 | 3026 |
| 877068 | N/A | N/A | 66018 | 66037 | GTTGCAGACATTTTACATAC | 32 | 3027 |
| 877092 | N/A | N/A | 67322 | 67341 | TAGAACCATACCTAAATAGT | 97 | 3028 |
| 877116 | N/A | N/A | 70348 | 70367 | GTAATACCCGAAAGAAGGGA | 53 | 3029 |
| 877140 | N/A | N/A | 72680 | 72699 | TGAAAAAGCTATATCCATAT | 120 | 3030 |
| 877164 | N/A | N/A | 74213 | 74232 | AAAAAAAACTTTCAGTAATC | 142 | 3031 |
| 877188 | N/A | N/A | 76212 | 76231 | AACACAATCCACAACAGAAT | 89 | 3032 |
| 877212 | N/A | N/A | 78681 | 78700 | AGGAGGAAAATACTATCCAA | 59 | 3033 |
| 877243 | N/A | N/A | 83326 | 83345 | TATATGCACAGTTTTGCTGA | 71 | 3034 |
| 877267 | N/A | N/A | 86866 | 86885 | AGAACAGAAAGCTCAGTTTT | 80 | 3035 |
| 877291 | N/A | N/A | 89005 | 89024 | CTCTCAGAAACATTTTCTCA | 66 | 3036 |
| 877315 | N/A | N/A | 90693 | 90712 | AACAAAACTTAAAAGTGTCT | 166 | 3037 |
| 877339 | N/A | N/A | 92828 | 92847 | AAACAACTCACACATTTCTA | 84 | 3038 |
| 877363 | N/A | N/A | 95003 | 95022 | AGTTGAGTTACCTCCTGATA | 72 | 3039 |
| 877387 | N/A | N/A | 96290 | 96309 | TCTGGTTACTAGAATGTAGC | 104 | 3040 |
| 877411 | N/A | N/A | 99458 | 99477 | GATTGCCTACTCCAAGGTTT | 56 | 3041 |
| 877435 | N/A | N/A | 101844 | 101863 | AGGCTTTTAATGAATATTTC | 80 | 3042 |
| 877459 | N/A | N/A | 104859 | 104878 | GGTATTGAGAGAGCTTCAGA | 51 | 3043 |
| 877483 | N/A | N/A | 106692 | 106711 | GAAAAGACAAACTAGGATTG | 70 | 3044 |
| 877507 | N/A | N/A | 109824 | 109843 | GTAGAACAGAGTCTGAAGTA | 67 | 3045 |
| 877531 | N/A | N/A | 111551 | 111570 | CTGTAACTCTGTTGAAATGT | 96 | 3046 |
| 877555 | N/A | N/A | 113739 | 113758 | TCAAAGACCACAGCCTTTCC | 116 | 3047 |
| 877579 | N/A | N/A | 116515 | 116534 | GCTAAGAGACTTCTTTCTTC | 48 | 3048 |
| 877603 | N/A | N/A | 118863 | 118882 | ACTAAAGTTTTTGCTGTTAC | 51 | 3049 |
| 877627 | N/A | N/A | 120815 | 120834 | CGGAAAAGACAAGAAGATAA | 82 | 3050 |
| 877651 | N/A | N/A | 122955 | 122974 | TTATCATGTGAATTAGCATA | 47 | 3051 |
| 877675 | N/A | N/A | 126419 | 126438 | CCAGACATTGCAAAGAAAAA | 65 | 3052 |
| 877699 | N/A | N/A | 129171 | 129190 | AGTGTGAAGGCACCGTAAGA | 73 | 3053 |
| 877723 | N/A | N/A | 133344 | 133363 | CCAATTCCATCCATTGAAAT | 69 | 3054 |
| 877747 | N/A | N/A | 137747 | 137766 | AAAAGTGATTAGGTTGAGTG | 62 | 3055 |
| 877771 | N/A | N/A | 140595 | 140614 | TATTTCTACATACCCCTCG | 93 | 3056 |
| 877795 | N/A | N/A | 142281 | 142300 | ATCTAAAATGTTCTCAAGAG | 136 | 3057 |
| 877819 | N/A | N/A | 144428 | 144447 | GTTGGCTTCTCAGAGGTTTT | 50 | 3058 |

TABLE 40

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 24 | 222 |
| 803632 | N/A | N/A | 81595<br>87852 | 81614<br>87871 | TAAAAAGCCATAGTGTTTGA | 91 | 1794 |
| 876018 | 441 | 460 | 10465 | 10484 | ACCAAGGACTTCCCAATCAT | 69 | 32 |
| 876042 | 828 | 847 | 21659 | 21678 | GAGGACTTCCACATTATTGC | 19 | 3059 |
| 876066 | 1105 | 1124 | 29366 | 29385 | TCTCATTCTTTTCCTCTAAA | 30 | 3060 |
| 876090 | 1471 | 1490 | 35418 | 35437 | CAGGAGAATGTATATGCTTC | 25 | 3061 |
| 876114 | 1580 | 1599 | 37629 | 37648 | CGTTTCATAACTGTTAGTAT | 46 | 3062 |
| 876138 | 2218 | 2237 | 56226 | 56245 | CATCCATAGCTACTTTTGCA | 54 | 3063 |
| 876162 | 2848 | 2867 | 71691 | 71710 | ATTCTCCTACACTAATTGAA | 64 | 3064 |
| 876186 | 3225 | 3244 | 76359 | 76378 | GTCCAAATGTGTCAAACTCT | 20 | 3065 |
| 876210 | 3797 | 3816 | 82142 | 82161 | ATCTGATTATGGCTAAATAA | 48 | 3066 |
| 876234 | 4048 | 4067 | 84043 | 84062 | TGGCTTTACATCCTATATGT | 43 | 3067 |
| 876258 | 4692 | 4711 | 92115 | 92134 | AAGTTCTACATAGCAGTCTG | 34 | 3068 |
| 876282 | 5044 | 5063 | 98192 | 98211 | GTGACATGTAGTTCTTTGGA | 11 | 3069 |
| 876306 | 5201 | 5220 | 99207 | 99226 | AAATAAGGCATTTCATATAG | 56 | 3070 |
| 876330 | 5650 | 5669 | 101288 | 101307 | TGGTGAGCCTTGGTTGATCT | 42 | 3071 |
| 876354 | 6155 | 6174 | 118488 | 118507 | TAGTCAGCAATCTTTGCAAT | 96 | 3072 |
| 876378 | 6782 | 6801 | 132492 | 132511 | ATGACCAGGAGAGTACCAGA | 69 | 3073 |
| 876402 | 7537 | 7556 | 145140 | 145159 | TTTTCCGGTTGTAGCCCAAT | 70 | 3074 |
| 876426 | 8594 | 8613 | 146763 | 146782 | TGTAGGATCTGCAGCATCAC | 60 | 3075 |
| 876450 | N/A | N/A | 3743 | 3762 | ACAATGCCTTTACCTGCTGC | 98 | 3076 |
| 876474 | N/A | N/A | 5889 | 5908 | TACTTCAGCCCAGGATTGCA | 70 | 3077 |
| 876498 | N/A | N/A | 7911 | 7930 | CTACATGGAACTTCTGTGAT | 71 | 3078 |
| 876522 | N/A | N/A | 10992 | 11011 | CAGATGTGCTGAAAGTTAAT | 62 | 3079 |
| 876546 | N/A | N/A | 14076 | 14095 | ATGAGATTTTTGAGAGGCAA | 107 | 3080 |
| 876570 | N/A | N/A | 15984 | 16003 | AATTTTTACATGAAGACTGT | 83 | 3081 |
| 876594 | N/A | N/A | 18271 | 18290 | CTAGAGAAAACTGACAGTGA | 80 | 3082 |
| 876618 | N/A | N/A | 20538 | 20557 | AAAGACTCTACCAGAAAAAG | 106 | 3083 |
| 876642 | N/A | N/A | 23590 | 23609 | AATGTATGGTGACTTGACCT | 97 | 3084 |
| 876666 | N/A | N/A | 26378 | 26397 | AACAAAACCACTTCTTCTTC | 69 | 3085 |
| 876690 | N/A | N/A | 28864 | 28883 | TGAAGAGAAAACCACACACT | 50 | 3086 |
| 876714 | N/A | N/A | 30858 | 30877 | TTATAGTTCATTTTTTAAGA | 159 | 3087 |
| 876738 | N/A | N/A | 32945 | 32964 | ACTCCAAAGACAATACAAAA | 102 | 3088 |
| 876762 | N/A | N/A | 34263 | 34282 | CAACTGGCCAATTTTCCTCT | 60 | 3089 |
| 876786 | N/A | N/A | 36893 | 36912 | GATACATTCCTTCTTTTCCA | 50 | 3090 |
| 876810 | N/A | N/A | 38645 | 38664 | CCTTTTCTTTGGGCCTCAGC | 55 | 3091 |
| 876834 | N/A | N/A | 40906 | 40925 | ACTTCTGAGGCTGCCTATTA | 102 | 3092 |
| 876858 | N/A | N/A | 42989 | 43008 | CCAATTCATCTTATGCAAAA | 50 | 3093 |
| 876882 | N/A | N/A | 46918 | 46937 | ATTTCCTGAGCCACCCTTCT | 62 | 3094 |
| 876906 | N/A | N/A | 48113 | 48132 | ATTAAGTACTTGTCCAGGGT | 41 | 3095 |
| 876930 | N/A | N/A | 50500 | 50519 | GACACAGAGAGCTGTGAGCA | 73 | 3096 |
| 876954 | N/A | N/A | 53300 | 53319 | GAATAACCATGCTGACTTTA | 66 | 3097 |
| 876978 | N/A | N/A | 56491 | 56510 | AAGACACAAACAATTGCAAT | 98 | 3098 |
| 877002 | N/A | N/A | 59243 | 59262 | TGATAGAAGTGTTTGGTTTT | 60 | 3099 |
| 877026 | N/A | N/A | 61360 | 61379 | GGTTAGCATGTGAGGTGCCA | 83 | 3100 |
| 877050 | N/A | N/A | 63441 | 63460 | AAGGTTACAACCATGAACAA | 158 | 3101 |
| 877074 | N/A | N/A | 66455 | 66474 | ATATTGCATAACTTAATAGC | 106 | 3102 |
| 877098 | N/A | N/A | 68250 | 68269 | AGAGCATTTTTCAACACCTA | 13 | 3103 |
| 877122 | N/A | N/A | 71326 | 71345 | ATAGTCCAGCAGGAAAAAGC | 81 | 3104 |
| 877146 | N/A | N/A | 73085 | 73104 | TGAATAATTGGAGGAAATTC | 98 | 3105 |
| 877170 | N/A | N/A | 74875 | 74894 | CTCTGTCTCCAGATATAAAA | 27 | 3106 |
| 877194 | N/A | N/A | 77081 | 77100 | AATTAGTTGTAAAAATGTAA | 118 | 3107 |
| 877218 | N/A | N/A | 79715 | 79734 | CAGGACACTCCTAGAAGCTG | 44 | 3108 |
| 877249 | N/A | N/A | 84418 | 84437 | TGCTATATGAAATACAGTGT | 58 | 3109 |
| 877273 | N/A | N/A | 87070 | 87089 | GACCATGTTTAGAGAACTAT | 48 | 3110 |
| 877297 | N/A | N/A | 89927 | 89946 | TTACATGACATTACCATCTA | 50 | 3111 |
| 877321 | N/A | N/A | 91204 | 91223 | CAGAATTTCTGCTTAAATTC | 56 | 3112 |
| 877345 | N/A | N/A | 93276 | 93295 | GAAACATGGAATCTAGAACA | 150 | 3113 |
| 877369 | N/A | N/A | 95294 | 95313 | CAAATTAACTTAATTTTTAC | 125 | 3114 |
| 877393 | N/A | N/A | 97092 | 97111 | GCCCAAGGACTTGTCTTACC | 52 | 3115 |
| 877417 | N/A | N/A | 100614 | 100633 | GTATCAAAACATACCTTCCT | 108 | 3116 |
| 877441 | N/A | N/A | 102459 | 102478 | TTCTCACCACATAAATATTT | 67 | 3117 |
| 877465 | N/A | N/A | 105189 | 105208 | CCTTGAAATGTAGTCACTTG | 61 | 3118 |
| 877489 | N/A | N/A | 107021 | 107040 | ACAGAAGGCGAAGTCAGGAG | 90 | 3119 |
| 877513 | N/A | N/A | 110256 | 110275 | GGCCACAGTGATCAGTTTGG | 56 | 3120 |
| 877537 | N/A | N/A | 112156 | 112175 | AAAAAATACATATCATCCCC | 124 | 3121 |
| 877561 | N/A | N/A | 114361 | 114380 | ATAATCCTTTATAATAAGTA | 118 | 3122 |
| 877585 | N/A | N/A | 117351 | 117370 | CACAAGACTTAATGGAGTTA | 61 | 3123 |
| 877609 | N/A | N/A | 119274 | 119293 | AACAAATGCCAACCCCTAAA | 103 | 3124 |
| 877633 | N/A | N/A | 121503 | 121522 | TATAGTATTTATATGGGTGT | 50 | 3125 |

TABLE 40-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877657 | N/A | N/A | 124119 | 124138 | ACAAAGGGAAATGGTTAAAC | 40 | 3126 |
| 877681 | N/A | N/A | 126991 | 127010 | ACGGGCACCCTACAAGAAAT | 117 | 3127 |
| 877705 | N/A | N/A | 129885 | 129904 | AGTAACTTTCCAAATGGTAT | 69 | 3128 |
| 877729 | N/A | N/A | 134033 | 134052 | CTCTGCCCCTTTTCCCAGAC | 83 | 3129 |
| 877753 | N/A | N/A | 138357 | 138376 | TTACCAGGTGCTGGTCATTA | 24 | 3130 |
| 877777 | N/A | N/A | 140907 | 140926 | ATAAAGAAAAATTACGAACA | 79 | 3131 |
| 877801 | N/A | N/A | 142946 | 142965 | TTTACCATTACCTCCCTAGA | 61 | 3132 |
| 877825 | N/A | N/A | 144861 | 144880 | CAGCTTAACCTTTCTATAAA | 60 | 3133 |

TABLE 41

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 16 | 222 |
| 876020 | 528 | 547 | 13794 | 13813 | GAGGAGATCTAAGGTCTTCA | 35 | 2603 |
| 876044 | 830 | 849 | 21661 | 21680 | ATGAGGACTTCCACATTATT | 47 | 2604 |
| 876068 | 1161 | 1180 | 29422 | 29441 | ACAGGCTTCCAGCCAAAACA | 63 | 2605 |
| 876092 | 1473 | 1492 | 35420 | 35439 | TTCAGGAGAATGTATATGCT | 46 | 2606 |
| 876116 | 1637 | 1656 | 37686 | 37705 | ATAAAATGTAAAATAGCTCA | 112 | 2607 |
| 876140 | 2262 | 2281 | 56270 | 56289 | ATTCTGATCACACGCTCTCT | 42 | 2608 |
| 876164 | 2869 | 2888 | 71712 | 71731 | GTAATACGGCATCTCGGTAA | 66 | 2609 |
| 876188 | 3228 | 3247 | 76362 | 76381 | CAAGTCCAAATGTGTCAAAC | 58 | 2610 |
| 876212 | 3800 | 3819 | 82145 | 82164 | CTGATCTGATTATGCTAAA | 59 | 2611 |
| 876236 | 4144 | 4163 | 86639 | 86658 | TTTTACCACTCCCAGTATTT | 114 | 2612 |
| 876260 | 4725 | 4744 | 92148 | 92167 | CACATTTTACGCTCCGATA | 31 | 2613 |
| 876284 | 5046 | 5065 | 98194 | 98213 | CTGTGACATGTAGTTCTTTG | 39 | 2614 |
| 876308 | 5338 | 5357 | 100190 | 100209 | CTTCAGGAGACCAATTTAAG | 48 | 2615 |
| 876332 | 5652 | 5671 | 101290 | 101309 | AATGGTGAGCCTTGGTTGAT | 57 | 2616 |
| 876356 | 6204 | 6223 | 118537 | 118556 | GCCCTCTGATGTTTTTATCC | 98 | 2617 |
| 876380 | 6826 | 6845 | 132536 | 132555 | TCATCTTTTCTAGGGTATGT | 43 | 2618 |
| 876404 | 7660 | 7679 | 145829 | 145848 | TTTCAGCTAATTCTTTTCTC | 56 | 2619 |
| 876428 | 8683 | 8702 | 146852 | 146871 | GAAAAGTGTTAGATATTTAT | 135 | 2620 |
| 876452 | N/A | N/A | 3761 | 3780 | GAATGAGTTGAAGTGAAAAC | 120 | 2621 |
| 876476 | N/A | N/A | 6208 | 6227 | ATCCAGTAATCTCATCGCTG | 47 | 2622 |
| 876500 | N/A | N/A | 8095 | 8114 | ATTCTGAACAGCTTCTGGTG | 136 | 2623 |
| 876524 | N/A | N/A | 11128 | 11147 | TTTTCCTGGAAACACATTCT | 114 | 2624 |
| 876548 | N/A | N/A | 14203 | 14222 | AAGGGCAGGAATGACCACTA | 72 | 2625 |
| 876572 | N/A | N/A | 16432 | 16451 | GCAATTGAAGAAAGTCTACT | 56 | 2626 |
| 876596 | N/A | N/A | 18903 | 18922 | GTTTCTCCAGCACCAAGCCC | 49 | 2627 |
| 876620 | N/A | N/A | 20690 | 20709 | TTCCAGAAGGGCAACCAATG | 100 | 2628 |
| 876644 | N/A | N/A | 23667 | 23686 | GAACTGGACAAGTTAATCCT | 47 | 2629 |
| 876668 | N/A | N/A | 26426 | 26445 | TGCTGTTCTAGACAATTTGG | 46 | 2630 |
| 876692 | N/A | N/A | 29204 | 29223 | AAGCCTTGGTCAATTATAAA | 91 | 2631 |
| 876716 | N/A | N/A | 30940 | 30959 | CACTTGCCATTATCAAATAT | 84 | 2632 |
| 876740 | N/A | N/A | 33139 | 33158 | TGTATGCAACCTTGGGACCT | 57 | 2633 |
| 876764 | N/A | N/A | 34714 | 34733 | TGGAAAGCATTTACATAGAA | 47 | 2634 |
| 876788 | N/A | N/A | 36957 | 36976 | TGTTAACTGAAACTTGTGCA | 70 | 2635 |
| 876812 | N/A | N/A | 38785 | 38804 | TCTATCATCCTCTGCACCAC | 69 | 2636 |
| 876836 | N/A | N/A | 41061 | 41080 | TAAGGAAGGCAGCCTTGATA | 54 | 2637 |
| 876860 | N/A | N/A | 43045 | 43064 | TTTATAAAAATGTTCACACT | 112 | 2638 |
| 876884 | N/A | N/A | 47090 | 47109 | AATCTCATCCATCTGTAATT | 50 | 2639 |
| 876908 | N/A | N/A | 48315 | 48334 | TACTCTGATTTCCTCATCTT | 58 | 2640 |
| 876932 | N/A | N/A | 50766 | 50785 | CTTTACAATGTCTTCTTTTA | 139 | 2641 |
| 876956 | N/A | N/A | 53309 | 53328 | ATAAATGGTGAATAACCATG | 60 | 2642 |
| 876980 | N/A | N/A | 56543 | 56562 | TGGATAACACCTAAAGGACC | 122 | 2643 |
| 877004 | N/A | N/A | 59276 | 59295 | GTATTTGGAGCAGTGCCCAG | 110 | 2644 |
| 877028 | N/A | N/A | 61596 | 61615 | GTACCTTAACACAGTAAATA | 82 | 2645 |
| 877052 | V/A | N/A | 63476 | 63495 | TAATCTACTATGTGCAAAAC | 100 | 2646 |
| 877076 | N/A | N/A | 66557 | 66576 | TCTACATTGTCAGGAAGCAA | 66 | 2647 |
| 877100 | N/A | N/A | 68445 | 68464 | ATCTCTCACAGATGCAAAAT | 82 | 2648 |
| 877124 | N/A | N/A | 71781 | 71800 | ATAATCACAATTGCACAATT | 109 | 2649 |

TABLE 41-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877148 | N/A | N/A | 73144 | 73163 | GAATCATTAGGTAAATATAT | 99 | 2650 |
| 877172 | N/A | N/A | 74948 | 74967 | AGTGGAGAAGAGAGAAAGAC | 92 | 2651 |
| 877196 | N/A | N/A | 77137 | 77156 | TATCAAAAACAATTTGCTTT | 136 | 2652 |
| 877220 | N/A | N/A | 79895 | 79914 | ACAGTCTCTTTTCTTATCTG | 76 | 2653 |
| 877232 | N/A | N/A | 81609 | 81628 | TTTAGTGTCAATTCTAAAAA | 119 | 2654 |
| 877251 | N/A | N/A | 84464 | 84483 | CAGTAGCTATAATGCTTTAA | 80 | 2655 |
| 877275 | N/A | N/A | 87627 | 87646 | TTTAGATTTCATTTAAGAAA | 105 | 2656 |
| 877299 | N/A | N/A | 89982 | 90001 | AATTACATGTCCAACAAGAG | 92 | 2657 |
| 877323 | N/A | N/A | 91362 | 91381 | AATAAAAGTATCTTCCAAAC | 91 | 2658 |
| 877347 | N/A | N/A | 93509 | 93528 | AAATTCACAAAAGTTTCTGC | 80 | 2659 |
| 877371 | N/A | N/A | 95698 | 95717 | TTTCATATCTCTTTTATCAT | 97 | 2660 |
| 877395 | N/A | N/A | 97239 | 97258 | TTTTGCTTTGTCAAATTCAC | 45 | 2661 |
| 877419 | N/A | N/A | 100725 | 100744 | CTATAATTGAATATACTATT | 108 | 2662 |
| 877443 | N/A | N/A | 102592 | 102611 | ATTAAATCAATCTAATGCAT | 105 | 2663 |
| 877467 | N/A | N/A | 105313 | 105332 | CTCAATCCCCAAGGAGTTTG | 60 | 2664 |
| 877491 | N/A | N/A | 107115 | 107134 | CTTTCACCCTGAACACACAG | 68 | 2665 |
| 877515 | N/A | N/A | 110361 | 110380 | CTCAACCCTCACCCATGCAG | 93 | 2666 |
| 877539 | N/A | N/A | 112217 | 112236 | CCTGCTTATAATCTCTGGTT | 87 | 2667 |
| 877563 | N/A | N/A | 114595 | 114614 | TCTGAAGGCTTACTATTTTA | 71 | 2668 |
| 877587 | N/A | N/A | 117410 | 117429 | ACTACAGCATTTCATGTGAT | 46 | 2669 |
| 877611 | N/A | N/A | 119355 | 119374 | ATGTATAGCCACCTGTAATT | 93 | 2670 |
| 877635 | N/A | N/A | 121814 | 121833 | CTTGGATAATTATCATAATG | 41 | 2671 |
| 877659 | N/A | N/A | 124271 | 124290 | TCTCTTGGGTTCATGCCTGA | 67 | 2672 |
| 877683 | N/A | N/A | 127120 | 127139 | TAAATATTTTTGTAGCTCTA | 83 | 2673 |
| 877707 | N/A | N/A | 130019 | 130038 | TGTTTCTAGGGACCCTGAGC | 58 | 2674 |
| 877731 | N/A | N/A | 134194 | 134213 | AAATGTTGAAATTGTTACAA | 150 | 2675 |
| 877755 | N/A | N/A | 138536 | 138555 | AAATGACAATTAGGAGGGTC | 78 | 2676 |
| 877779 | N/A | N/A | 141131 | 141150 | CTTGCAAAACTTTGTTTCAT | 66 | 2677 |
| 877803 | N/A | N/A | 143288 | 143307 | AATTTATACCAGTCTTATGT | 126 | 2678 |
| 877827 | N/A | N/A | 144888 | 144907 | ATTCTTAATTATGTGAGTCT | 77 | 2679 |

TABLE 42

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 35 | 222 |
| 803640 | N/A | N/A | 81631 87888 | 81650 87907 | TGCAGCATCATGCAAGCAGC | 22 | 1802 |
| 876022 | 547 | 566 | N/A | N/A | TGATTTTACCTGAAGTTAGG | 82 | 3134 |
| 876046 | 832 | 851 | 21663 | 21682 | TCATGAGGACTTCCACATTA | 50 | 3135 |
| 876070 | 1231 | 1250 | 29582 | 29601 | GATTATTTAGTGCCCAGCAT | 47 | 3136 |
| 876094 | 1475 | 1494 | 35422 | 35441 | ACTTCAGGAGAATGTATATG | 58 | 3137 |
| 876118 | 1683 | 1702 | 41916 | 41935 | ATGAAATTCTGTATCCTCCC | 70 | 3138 |
| 876142 | 2306 | 2325 | 56314 | 56333 | GCATCTGCTCCCAATAGAAG | 48 | 3139 |
| 876166 | 2871 | 2890 | 71714 | 71733 | CTGTAATACGGCATCTCGGT | 25 | 3140 |
| 876190 | 3231 | 3250 | 76365 | 76384 | GTGCAAGTCCAAATGTGTCA | 15 | 3141 |
| 876214 | 3803 | 3822 | 82148 | 82167 | ATGCTGATCTGATTATGGCT | 76 | 3142 |
| 876238 | 4190 | 4209 | 86685 | 86704 | CCAAGATCTGATTTCTTGGT | 72 | 139 |
| 876262 | 4728 | 4747 | 92151 | 92170 | TGGCACATTTTTACGCTCCG | 26 | 3143 |
| 876286 | 5049 | 5068 | 98197 | 98216 | ATACTGTGACATGTAGTTCT | 24 | 3144 |
| 876310 | 5429 | 5448 | N/A | N/A | AGAATACAGCCTTTTCTACA | 53 | 3145 |
| 876334 | 5655 | 5674 | 101293 | 101312 | TGGAATGGTGAGCCTTGGTT | 41 | 3146 |
| 876358 | 6249 | 6268 | 124880 | 124899 | AATGACATTTCCTCTGGCAA | 69 | 3147 |
| 876382 | 6870 | 6889 | 132580 | 132599 | TTGCTTGGAAAAGGAATTGC | 63 | 3148 |
| 876406 | 7747 | 7766 | 145916 | 145935 | AATAAATATTTACAAGAGGA | 165 | 3149 |
| 876430 | 8774 | 8793 | 146943 | 146962 | GCTATGTAAACAATTTAAGT | 96 | 3150 |
| 876454 | N/A | N/A | 4075 | 4094 | ATTGGGAAGATACTTGGAAT | 86 | 3151 |
| 876478 | N/A | N/A | 6864 | 6883 | ACACAAATCATTTCAAAATG | 80 | 3152 |
| 876502 | N/A | N/A | 8430 | 8449 | GGCACAAGTTTCTTACTCGC | 56 | 3153 |
| 876526 | N/A | N/A | 11515 | 11534 | TCTAATTTGTCTAAATTTAT | 120 | 3154 |
| 876550 | N/A | N/A | 14441 | 14460 | CTCTGCACTTCAGTGTTTGT | 55 | 3155 |

TABLE 42-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876574 | N/A | N/A | 16653 | 16672 | ATCTCAGTTATCAATCTCAG | 51 | 3156 |
| 876598 | N/A | N/A | 19231 | 19250 | ATAACCCCACACCTTTACTG | 239 | 3157 |
| 876622 | N/A | N/A | 20813 | 20832 | CGAGGCTCAACCCCATTGGA | 58 | 3158 |
| 876646 | N/A | N/A | 23976 | 23995 | TATATAATTGCTAGGTAGAG | 52 | 3159 |
| 876670 | N/A | N/A | 26660 | 26679 | TCATTCAGCTACTTTTGAAA | 55 | 3160 |
| 876694 | N/A | N/A | 29232 | 29251 | ACCAACAGAATGAGGTGTGC | 36 | 3161 |
| 876718 | N/A | N/A | 30990 | 31009 | ATTCAAACAAAATGTTAGTA | 125 | 3162 |
| 876742 | N/A | N/A | 33417 | 33436 | ACTCAATAGTCACCTTCTTT | 60 | 3163 |
| 876766 | N/A | N/A | 34874 | 34893 | ATGTGGAGGTATCGACCATT | 32 | 3164 |
| 876790 | N/A | N/A | 37365 | 37384 | CGGGAATTATTTCACTTCAT | 21 | 3165 |
| 876814 | N/A | N/A | 38809 | 38828 | CCTTGTATCTAGTCTCTCTC | 49 | 3166 |
| 876838 | N/A | N/A | 41299 | 41318 | CTACAAGTCAAAAATGTGGT | 71 | 3167 |
| 876862 | N/A | N/A | 43081 | 43100 | ATCATTTCCATTAATTATTT | 72 | 3168 |
| 876886 | N/A | N/A | 47247 | 47266 | CTTAGAATGAAATTGCTGAT | 48 | 3169 |
| 876910 | N/A | N/A | 48381 | 48400 | TGCCAATGTGGAGTTAATTT | 103 | 3170 |
| 876934 | N/A | N/A | 50807 | 50826 | TAATTATTCTCAGTCTTTAA | 110 | 3171 |
| 876958 | N/A | N/A | 53342 | 53361 | TCTTAGCACATTCTCTGAAC | 61 | 3172 |
| 876982 | N/A | N/A | 56609 | 56628 | GACACATTTGAAAAGTTATT | 45 | 3173 |
| 877006 | N/A | N/A | 59726 | 59745 | TCTTTAGAATATTCACACAT | 112 | 3174 |
| 877030 | N/A | N/A | 61906 | 61925 | ACTGGCAAATCAAACTTCAT | 104 | 3175 |
| 877054 | N/A | N/A | 63890 | 63909 | AATGTAATCTTTATCAGGAC | 65 | 3176 |
| 877078 | N/A | N/A | 66625 | 66644 | TTGGAAAACAGACACAAAAG | 61 | 3177 |
| 877102 | N/A | N/A | 68600 | 68619 | GGCCTTTGCTGGTGAAGTCT | 39 | 3178 |
| 877126 | N/A | N/A | 71855 | 71874 | GAAATCCCTACCAATTGTTC | 119 | 3179 |
| 877150 | N/A | N/A | 73433 | 73452 | CAATCAGGCTTTCTTCAAGG | 88 | 3180 |
| 877174 | N/A | N/A | 75007 | 75026 | TGATGAAGTGACAGTTAAAT | 116 | 3181 |
| 877198 | N/A | N/A | 77396 | 77415 | GTACAACTTAGAGGGCCTGG | 38 | 3182 |
| 877222 | N/A | N/A | 80337 | 80356 | AGTTCTCAATACTCTGGTAT | 35 | 3183 |
| 877253 | N/A | N/A | 84478 | 84497 | ATTTCACATGATGTCAGTAG | 61 | 3184 |
| 877277 | N/A | N/A | 87800 | 87819 | AGATAGAAAAGCAACAAAAG | 153 | 3185 |
| 877301 | N/A | N/A | 90174 | 90193 | CAACAAGTCTTTTTAAAGAT | 74 | 3186 |
| 877325 | N/A | N/A | 91493 | 91512 | AACATCAGTGATTCTGATAG | 136 | 3187 |
| 877349 | N/A | N/A | 93656 | 93675 | GGATCTAGTAAAGCAGCATG | 39 | 3188 |
| 877373 | N/A | N/A | 95702 | 95721 | TCTCTTTCATATCTCTTTTA | 42 | 3189 |
| 877397 | N/A | N/A | 97648 | 97667 | GAATAGGAAGACAGACTGTG | 69 | 3190 |
| 877421 | N/A | N/A | 100889 | 100908 | TCTTTATAACAGTTCTATGA | 99 | 3191 |
| 877445 | N/A | N/A | 102737 | 102756 | GACAACTTTTTGCTAATAAT | 70 | 3192 |
| 877469 | N/A | N/A | 105355 | 105374 | TTCAGGCCTCCATACCCTTG | 184 | 3193 |
| 877493 | N/A | N/A | 107755 | 107774 | AGAGAATCCATTTGACTTTG | 37 | 3194 |
| 877517 | N/A | N/A | 110432 | 110451 | GAATACAGGAATAACCACTG | 61 | 3195 |
| 877541 | N/A | N/A | 112355 | 112374 | AACAGTGCACACAGTGTAGT | 46 | 3196 |
| 877565 | N/A | N/A | 114614 | 114633 | CTACTGTCAACACAGTAATT | 72 | 3197 |
| 877589 | N/A | N/A | 117436 | 117455 | CTTCTCTGCCCCATGATGTC | 56 | 3198 |
| 877613 | N/A | N/A | 119406 | 119425 | TTTCTTCTGTGCCAGGCACG | 47 | 3199 |
| 877637 | N/A | N/A | 121914 | 121933 | GCCACTATTAAGTGGTAGAG | 52 | 3200 |
| 877661 | N/A | N/A | 124653 | 124672 | CCAAGGTTGACCACACAGGA | 66 | 3201 |
| 877685 | N/A | N/A | 127508 | 127527 | TCATAAGATTTGACAGCATG | 48 | 3202 |
| 877709 | N/A | N/A | 130133 | 130152 | TTCAGAAACCACATTTCTGC | 123 | 3203 |
| 877733 | N/A | N/A | 134456 | 134475 | CAATCAGCAAGTATTTTCAG | 113 | 3204 |
| 877757 | N/A | N/A | 138991 | 139010 | GTGGTGCTTGGACTGAAATA | 85 | 3205 |
| 877781 | N/A | N/A | 141186 | 141205 | TTGTACTATATCTAAATTTC | 89 | 3206 |
| 877805 | N/A | N/A | 143353 | 143372 | TAATCTGCTTCTCTTGTGGG | 71 | 3207 |
| 877829 | N/A | N/A | 145054 | 145073 | ATATTAAACTGGCCTGAAAA | 145 | 3208 |

TABLE 43

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 49 | 222 |
| 803641 | N/A | N/A | 81632 87889 | 81651 87908 | TTGCAGCATCATGCAAGCAG | 57 | 1803 |

TABLE 43-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876023 | 662 | 681 | 16182 | 16201 | AGCACATGTAAAGCTTTGCA | 51 | 3209 |
| 876047 | 833 | 852 | 21664 | 21683 | CTCATGAGGACTTCCACATT | 60 | 3210 |
| 876071 | 1232 | 1251 | 29583 | 29602 | AGATTATTTAGTGCCCAGCA | 43 | 3211 |
| 876095 | 1476 | 1495 | 35423 | 35442 | CACTTCAGGAGAATGTATAT | 35 | 3212 |
| 876119 | 1694 | 1713 | 41927 | 41946 | TTTAGCTTATGATGAAATTC | 36 | 3213 |
| 876143 | 2395 | 2414 | 62016 | 62035 | CACTATTCAGTAAGAGTTCC | 19 | 3214 |
| 876167 | 2873 | 2892 | 71716 | 71735 | CGCTGTAATACGGCATCTCG | 58 | 3215 |
| 876191 | 3250 | 3269 | 76384 | 76403 | ATGATGTAAATTTATTACTG | 75 | 3216 |
| 876215 | 3804 | 3823 | 82149 | 82168 | GATGCTGATCTGATTATGGC | 33 | 3217 |
| 876239 | 4232 | 4251 | 86727 | 86746 | GGCCAGTCTTTCACATCTAT | 39 | 3218 |
| 876263 | 4729 | 4748 | 92152 | 92171 | TTGGCACATTTTTACGCTCC | 21 | 3219 |
| 876287 | 5050 | 5069 | 98198 | 98217 | AATACTGTGACATGTAGTTC | 38 | 3220 |
| 876311 | 5434 | 5453 | N/A | N/A | CCAAAAGAATACAGCCTTTT | 52 | 3221 |
| 876335 | 5660 | 5679 | 101298 | 101317 | GATATTGGAATGGTGAGCCT | 28 | 3222 |
| 876359 | 6288 | 6307 | 124919 | 124938 | TAGTAAACCAAATGAATAAA | 78 | 3223 |
| 876383 | 6953 | 6972 | N/A | N/A | CCTTTAAGCTTAACAGTCTT | 125 | 3224 |
| 876407 | 7856 | 7875 | 146025 | 146044 | TTACTGGTAAGTATTTTTAC | 57 | 3225 |
| 876431 | 8779 | 8798 | 146948 | 146967 | GGTAAGCTATGTAAACAATT | 105 | 3226 |
| 876455 | N/A | N/A | 4112 | 4131 | AACTATTCATAATCTTCTCA | 93 | 3227 |
| 876479 | N/A | N/A | 6910 | 6929 | TTGGCTGTGCAAAAGAAGGA | 112 | 3228 |
| 876503 | N/A | N/A | 8563 | 8582 | CTGCTACATGATAAGGAAGC | 62 | 3229 |
| 876527 | N/A | N/A | 11614 | 11633 | CACACCCTTTATGTACTGAA | 33 | 3230 |
| 876551 | N/A | N/A | 14462 | 14481 | TCTTAGTGGCCAAAGCAACT | 80 | 3231 |
| 876575 | N/A | N/A | 16768 | 16787 | TCACAAGCTCTGTGTCCTCA | 45 | 3232 |
| 876599 | N/A | N/A | 19233 | 19252 | TCATAACCCCACACCTTTAC | 91 | 3233 |
| 876623 | N/A | N/A | 20902 | 20921 | TTTTTTTTGATGTGGAGAAA | 161 | 3234 |
| 876647 | N/A | N/A | 24058 | 24077 | GACTCATGTAAGAAGACAAG | 48 | 3235 |
| 876671 | N/A | N/A | 26694 | 26713 | TTTAATTTTAACTATGAAGA | 101 | 3236 |
| 876695 | N/A | N/A | 29272 | 29291 | TAACAGTTTGACCAACTCTA | 76 | 3237 |
| 876719 | N/A | N/A | 30991 | 31010 | AATTCAAACAAAATGTTAGT | 180 | 3238 |
| 876743 | N/A | N/A | 33419 | 33438 | TTACTCAATAGTCACCTTCT | 62 | 3239 |
| 876767 | N/A | N/A | 34973 | 34992 | TTCCAATACTTAAAACAAGT | 76 | 3240 |
| 876791 | N/A | N/A | 37386 | 37405 | AAGATAGAATTCATAGTAAT | 108 | 3241 |
| 876815 | N/A | N/A | 38831 | 38850 | CCATGGACCTCCAACCCAAT | 86 | 3242 |
| 876839 | N/A | N/A | 41301 | 41320 | CACTACAAGTCAAAAATGTG | 62 | 3243 |
| 876863 | N/A | N/A | 43157 | 43176 | ATTTTTAAGGGAGATCTCTC | 56 | 3244 |
| 876887 | N/A | N/A | 47300 | 47319 | TTCATGTCTAATAATCTTTA | 64 | 3245 |
| 876911 | N/A | N/A | 48530 | 48549 | TCTAAAGAAATTCAGACAAC | 115 | 3246 |
| 876935 | N/A | N/A | 50878 | 50897 | CAAAGAAAAAAGTCCAATAA | 168 | 3247 |
| 876959 | N/A | N/A | 53439 | 53458 | GCAACCTGCAATAAAACCCA | 43 | 3248 |
| 876983 | N/A | N/A | 56638 | 56657 | AGACTAAGTTGTAGAGATGC | 79 | 3249 |
| 877007 | N/A | N/A | 59787 | 59806 | TAAAATAAATAAATGCCAGC | 125 | 3250 |
| 877031 | N/A | N/A | 62296 | 62315 | ACTAAAAGACTAGTGACTTA | 69 | 3251 |
| 877055 | N/A | N/A | 64013 | 64032 | GAACCCATTTCTGGAGGGTT | 180 | 3252 |
| 877079 | N/A | N/A | 66732 | 66751 | CACTAGAACAGCTAAAAGTA | 172 | 3253 |
| 877103 | N/A | N/A | 68807 | 68826 | TCACTAACAGGATAATTAAA | 103 | 3254 |
| 877127 | N/A | N/A | 72021 | 72040 | TGAAGTGTACTGTAAGTATA | 46 | 3255 |
| 877151 | N/A | N/A | 73765 | 73784 | CTTGAAAGTTACAAGGATAA | 60 | 3256 |
| 877175 | N/A | N/A | 75058 | 75077 | GGTGGGTAGGTTGGCTGGAG | 88 | 3257 |
| 877199 | N/A | N/A | 77450 | 77469 | ACTGAAATGCCACTTTTAAA | 74 | 3258 |
| 877223 | N/A | N/A | 80422 | 80441 | ATGGGTGTTATTAATAAAA | 65 | 3259 |
| 877254 | N/A | N/A | 84582 | 84601 | AAGTGTAAAGACCAGAAACA | 169 | 3260 |
| 877278 | N/A | N/A | 87864 | 87883 | TAGTCTCCATTCTAAAAAGC | 64 | 3261 |
| 877302 | N/A | N/A | 90291 | 90310 | GACTTATTGGTAATGATATC | 57 | 3262 |
| 877326 | N/A | N/A | 91566 | 91585 | GCAGAGACATAAAATCCCAC | 36 | 3263 |
| 877350 | N/A | N/A | 93891 | 93910 | TTCCATGTGAAATATAAGAA | 79 | 3264 |
| 877374 | N/A | N/A | 95756 | 95775 | AAGGTTAAATTGCCATGTAA | 45 | 3265 |
| 877398 | N/A | N/A | 97666 | 97685 | CTAGGAGGGACTTCCATGA | 52 | 3266 |
| 877422 | N/A | N/A | 100940 | 100959 | ATTATATGGCAGACATGTTG | 73 | 3267 |
| 877446 | N/A | N/A | 102740 | 102759 | TTGGACAACTTTTTGCTAAT | 72 | 3268 |
| 877470 | N/A | N/A | 105358 | 105377 | ACCTTCAGGCCTCCATACCC | 95 | 3269 |
| 877494 | N/A | N/A | 107793 | 107812 | CCTTTATTTTATAAATTGA | 51 | 3270 |
| 877518 | N/A | N/A | 110571 | 110590 | TACAGTTGAGTTCTGGTATA | 100 | 3271 |
| 877542 | N/A | N/A | 112357 | 112376 | GAAACAGTGCACACAGTGTA | 56 | 3272 |
| 877566 | N/A | N/A | 114956 | 114975 | AAAAACTAGAACCTAGAGTT | 90 | 3273 |
| 877590 | N/A | N/A | 117469 | 117488 | AGATGTCTATAAAATTCTGA | 77 | 3274 |
| 877614 | N/A | N/A | 119511 | 119530 | AACCAGGCATTGGAATCTGG | 65 | 3275 |
| 877638 | N/A | N/A | 121934 | 121953 | AATTTCTTGATGAACATCAT | 69 | 3276 |
| 877662 | N/A | N/A | 124733 | 124752 | CTAAACCAGGCTGTGTTATT | 75 | 3277 |
| 877686 | N/A | N/A | 127511 | 127530 | TTTTCATAAGATTTGACAGC | 83 | 3278 |
| 877710 | N/A | N/A | 130554 | 130573 | TTTAACCTCAGAACTAATGT | 152 | 3279 |

TABLE 43-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877734 | N/A | N/A | 134509 | 134528 | ATCAGATGTCATTTATCATT | 67 | 3280 |
| 877758 | N/A | N/A | 139025 | 139044 | AGCACAAAGTCACCTAACCT | 50 | 3281 |
| 877782 | N/A | N/A | 141209 | 141228 | TCTATGTGGCTCTTTGTAGA | 50 | 3282 |
| 877806 | N/A | N/A | 143361 | 143380 | AGCTGCAGTAATCTGCTTCT | 33 | 3283 |
| 877830 | N/A | N/A | 145056 | 145075 | ATATATTAAACTGGCCTGAA | 152 | 3284 |

TABLE 44

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 23 | 222 |
| 780625 | N/A | N/A | 81633 87890 | 81652 87909 | ATTGCAGCATCATGCAAGCA | 56 | 675 |
| 876024 | 667 | 686 | 16187 | 16206 | CAAACAGCACATGTAAAGCT | 75 | 3285 |
| 876048 | 834 | 853 | 21665 | 21684 | ACTCATGAGGACTTCCACAT | 42 | 3286 |
| 876072 | 1233 | 1252 | 29584 | 29603 | GAGATTATTTAGTGCCCAGC | 30 | 3287 |
| 876096 | 1477 | 1496 | 35424 | 35443 | CCACTTCAGGAGAATGTATA | 48 | 3288 |
| 876120 | 1696 | 1715 | 41929 | 41948 | TATTTAGCTTATGATGAAAT | 58 | 3289 |
| 876144 | 2400 | 2419 | 62021 | 62040 | AGATCCACTATTCAGTAAGA | 42 | 3290 |
| 876168 | 2874 | 2893 | 71717 | 71736 | ACGCTGTAATACGGCATCTC | 26 | 3291 |
| 876192 | 3289 | 3308 | 76423 | 76442 | GATTAGCAATACAACTCATT | 41 | 3292 |
| 876216 | 3805 | 3824 | 82150 | 82169 | AGATGCTGATCTGATTATGG | 46 | 3293 |
| 876240 | 4237 | 4256 | 86732 | 86751 | GGATAGGCCAGTCTTTCACA | 43 | 3294 |
| 876264 | 4731 | 4750 | 92154 | 92173 | AATTGGCACATTTTTACGCT | 41 | 3295 |
| 876288 | 5052 | 5071 | 98200 | 98219 | AAAATACTGTGACATGTAGT | 26 | 3296 |
| 876312 | 5444 | 5463 | 100433 | 100452 | ACAACTTGGCCCAAAAGAAT | 101 | 3297 |
| 876336 | 5690 | 5709 | 101328 | 101347 | TCAGCCAAAATCAAGTCAGG | 50 | 3298 |
| 876360 | 6293 | 6312 | 124924 | 124943 | TAGAGTAGTAAACCAAATGA | 82 | 3299 |
| 876384 | 6958 | 6977 | N/A | N/A | CAGCTCCTTTAAGCTTAACA | 73 | 3300 |
| 876408 | 7861 | 7880 | 146030 | 146049 | CACATTTACTGGTAAGTATT | 52 | 3301 |
| 876432 | 8818 | 8837 | 146987 | 147006 | AATTATTACATAGGTATTTG | 97 | 3302 |
| 876456 | N/A | N/A | 4226 | 4245 | GGTATACTACAACTAAAGGC | 45 | 3303 |
| 876480 | N/A | N/A | 6916 | 6935 | CAAATATTGGCTGTGCAAAA | 50 | 3304 |
| 876504 | N/A | N/A | 8607 | 8626 | TAAGCCAGATTGTATAAGAA | 91 | 3305 |
| 876528 | N/A | N/A | 11615 | 11634 | ACACACCCTTTATGTACTGA | 35 | 3306 |
| 876552 | N/A | N/A | 14467 | 14486 | CTACCTCTTAGTGGCCAAAG | 58 | 3307 |
| 876576 | N/A | N/A | 16784 | 16803 | TAATTGAACTGTACTGTCAC | 77 | 3308 |
| 876600 | N/A | N/A | 19236 | 19255 | CACTCATAACCCCACACCTT | 68 | 3309 |
| 876624 | N/A | N/A | 20923 | 20942 | TGTTATATTGCTTACCTTTT | 69 | 3310 |
| 876648 | N/A | N/A | 24093 | 24112 | TCAATGGCTCTATTTAACAC | 74 | 3311 |
| 876672 | N/A | N/A | 26696 | 26715 | GTTTTAATTTTAACTATGAA | 63 | 3312 |
| 876696 | N/A | N/A | 29292 | 29311 | CATTATATATATTATCTACT | 94 | 3313 |
| 876720 | N/A | N/A | 30992 | 31011 | AAATTCAAACAAAATGTTAG | 77 | 3314 |
| 876744 | N/A | N/A | 33420 | 33439 | CTTACTCAATAGTCACCTTC | 51 | 3315 |
| 876768 | N/A | N/A | 35168 | 35187 | ACACATGTCATTTCCAATTT | 38 | 3316 |
| 876792 | N/A | N/A | 37410 | 37429 | TAATTGTCTAAACTTTGAAC | 72 | 3317 |
| 876816 | N/A | N/A | 38923 | 38942 | TCACATCAAACAGATCTCCC | 68 | 3318 |
| 876840 | N/A | N/A | 41323 | 41342 | TGTAGCTGAACTATGCTAAA | 118 | 3319 |
| 876864 | N/A | N/A | 43234 | 43253 | TGTATTAAAGTTTGAGTATA | 77 | 3320 |
| 876888 | N/A | N/A | 47312 | 47331 | CCACAGTGAACATTCATGTC | 39 | 3321 |
| 876912 | N/A | N/A | 48595 | 48614 | GTCCAAATATAAAGGCAAAA | 36 | 3322 |
| 876936 | N/A | N/A | 51297 | 51316 | AGAAGTGGTAAGTTAAAAAG | 101 | 3323 |
| 876960 | N/A | N/A | 53567 | 53586 | CCAGTATCTTGAATTCCTTA | 38 | 3324 |
| 876984 | N/A | N/A | 56680 | 56699 | TATCAAAACATTAGAACTAT | 86 | 3325 |
| 877008 | N/A | N/A | 59803 | 59822 | GAGAAAGTGAATCTGATAAA | 48 | 3326 |
| 877032 | N/A | N/A | 62335 | 62354 | ATCTTTGGCTTAAGGTCCCT | 54 | 3327 |
| 877056 | N/A | N/A | 64117 | 64136 | TGAAGATTAAAGTAAGCAGG | 46 | 3328 |
| 877080 | N/A | N/A | 66821 | 66840 | AATAAGAATGGCCAATAAGA | 97 | 3329 |
| 877104 | N/A | N/A | 68820 | 68839 | CAGGATAATTAAATCACTAA | 89 | 3330 |
| 877128 | N/A | N/A | 72024 | 72043 | TCTTGAAGTGTACTGTAAGT | 36 | 3331 |
| 877152 | N/A | N/A | 73771 | 73790 | AAATGTCTTGAAAGTTACAA | 58 | 3332 |

TABLE 44-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877176 | N/A | N/A | 75109 | 75128 | ACCGAATGAGAATTAGGTGG | 22 | 3333 |
| 877200 | N/A | N/A | 77633 | 77652 | ATAATTTTGTCTCTTCCAGA | 61 | 3334 |
| 877224 | N/A | N/A | 80461 | 80480 | TATGGTACTAGCTCATAAAG | 87 | 3335 |
| 877255 | N/A | N/A | 84665 | 84684 | TATGAGAAAGTAATAAGACC | 103 | 3336 |
| 877279 | N/A | N/A | 87867 | 87886 | GTTTAGTCTCCATTCTAAAA | 58 | 3337 |
| 877303 | N/A | N/A | 90326 | 90345 | AGGTGATTTATAAGTGCCAA | 28 | 3338 |
| 877327 | N/A | N/A | 91617 | 91636 | GGTTATTTGTAAAATGTTAT | 33 | 3339 |
| 877351 | N/A | N/A | 93895 | 93914 | CATTTTCCATGTGAAATATA | 50 | 3340 |
| 877375 | N/A | N/A | 95790 | 95809 | AAAATTCCTTTGTATTTCTCC | 31 | 3341 |
| 877399 | N/A | N/A | 97756 | 97775 | GTCTCATCAATAATATATTC | 46 | 3342 |
| 877423 | N/A | N/A | 100944 | 100963 | TGTTATTATATGGCAGACAT | 66 | 3343 |
| 877447 | N/A | N/A | 102748 | 102767 | CTCAAATTTTGGACAACTTT | 66 | 3344 |
| 877471 | N/A | N/A | 105367 | 105386 | ATGCTTTGTACCTTCAGGCC | 39 | 3345 |
| 877495 | N/A | N/A | 108045 | 108064 | TTAGAAACACTTGAAGTCAT | 61 | 3346 |
| 877519 | N/A | N/A | 110743 | 110762 | AATTAAAATGCCCCCAGGAT | 74 | 3347 |
| 877543 | N/A | N/A | 112384 | 112403 | CTCTGTTTTTATCAGACATT | 49 | 3348 |
| 877567 | N/A | N/A | 115086 | 115105 | GTTATTTAAAGTAAGGTTTC | 52 | 3349 |
| 877591 | N/A | N/A | 117552 | 117571 | TTCATCTCAACCAGGTCTTA | 67 | 3350 |
| 877615 | N/A | N/A | 119913 | 119932 | AGTTGCATATGGTTTAGGAG | 29 | 3351 |
| 877639 | N/A | N/A | 122135 | 122154 | AATATTTACTTCAATATGGA | 68 | 3352 |
| 877663 | N/A | N/A | 124792 | 124811 | CATCCAAGGAGGCATACACT | 78 | 3353 |
| 877687 | N/A | N/A | 127780 | 127799 | TTAAAGGAAAAGTTAACCAG | 75 | 3354 |
| 877711 | N/A | N/A | 132127 | 132146 | GATTGTTCCTCTCCCTCTCC | 57 | 3355 |
| 877735 | N/A | N/A | 134694 | 134713 | TAATGACTAAATAGGAATCT | 89 | 3356 |
| 877759 | N/A | N/A | 139104 | 139123 | GTAGATTTAGTGGTATTGAG | 54 | 3357 |
| 877783 | N/A | N/A | 141286 | 141305 | ACTTTATATTAATTTCTTGT | 67 | 3358 |
| 877807 | N/A | N/A | 143430 | 143449 | TACCATGTATTTCCCATTTT | 61 | 3359 |
| 877831 | N/A | N/A | 145069 | 145088 | TTCTGTTAAAACTATATATT | 128 | 3360 |

TABLE 45

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 16 | 222 |
| 876028 | 732 | 751 | 18631 | 18650 | ACTTAACAATATCATATAAT | 116 | 3361 |
| 876052 | 840 | 859 | 21671 | 21690 | ATTGCCACTCATGAGGACTT | 23 | 3362 |
| 876076 | 1239 | 1258 | 29590 | 29609 | CATAAGGAGATTATTTAGTG | 51 | 3363 |
| 876100 | 1482 | 1501 | 35429 | 35448 | TTCAGCCACTTCAGGAGAAT | 36 | 3364 |
| 876124 | 1701 | 1720 | 41934 | 41953 | AACCATATTTAGCTTATGAT | 35 | 3365 |
| 876148 | 2452 | 2471 | 62073 | 62092 | TGTCACCTTTCCCAATGCTT | 37 | 3366 |
| 876172 | 2977 | 2996 | 73001 | 73020 | GTGAATCATCTGAAGATAAT | 79 | 3367 |
| 876196 | 3422 | 3441 | 76556 | 76575 | TCTACCACATCAGTGAGGTT | 46 | 3368 |
| 876220 | 3850 | 3869 | 82195 | 82214 | GTTTCTCTACTCTAGACCAT | 29 | 3369 |
| 876244 | 4313 | 4332 | 87217 | 87236 | GTACTATAGAATTCCTCACG | 33 | 3370 |
| 876268 | 4736 | 4755 | 92159 | 92178 | AATTCAATTGGCACATTTTT | 80 | 3371 |
| 876292 | 5070 | 5089 | 98218 | 98237 | GAATTTTTCTAGGAGCTTAA | 47 | 3372 |
| 876316 | 5450 | 5469 | 100439 | 100458 | TGGTCCACAACTTGGCCCAA | 45 | 3373 |
| 876340 | 5704 | 5723 | 101342 | 101361 | TATTTCTAGGCAGGTCAGCC | 62 | 3374 |
| 876364 | 6471 | 6490 | 126587 | 126606 | AGGCCTTTCTTGAGGATTTT | 56 | 3375 |
| 876388 | 7076 | 7095 | 137480 | 137499 | GAGAAAATCTTTGTGCCACA | 66 | 3376 |
| 876412 | 8045 | 8064 | 146214 | 146233 | ACAGAATTTAAAATAAAGTT | 64 | 3377 |
| 876436 | 8906 | 8925 | 147075 | 147094 | TATCACAGGGAATTATCTGA | 113 | 3378 |
| 876460 | N/A | N/A | 4437 | 4456 | ATCACCTTGGCCTATAATTT | 73 | 3379 |
| 876484 | N/A | N/A | 7124 | 7143 | TTGCTTTTTACTAGCTTGCA | 38 | 3380 |
| 876508 | N/A | N/A | 9022 | 9041 | GGCTCTTTCACATTTCGAAA | 63 | 3381 |
| 876532 | N/A | N/A | 11902 | 11921 | TTTCCTACATAAACTTTTAT | 137 | 3382 |
| 876556 | N/A | N/A | 14858 | 14877 | GTTGAGTACCTTCTTGTTTT | 43 | 3383 |
| 876580 | N/A | N/A | 17001 | 17020 | TCTTGTGTATTATAATTATC | 55 | 3384 |
| 876604 | N/A | N/A | 19521 | 19540 | AGCAATCATTGGTAGCATAC | 17 | 3385 |
| 876628 | N/A | N/A | 21334 | 21353 | GTACTGAAAATGAAAGTCTG | 79 | 3386 |
| 876652 | N/A | N/A | 24857 | 24876 | AAGGTAAGGTCTCAACCAGA | 41 | 3387 |

TABLE 45-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876676 | N/A | N/A | 27470 | 27489 | TCATTGGCATGTTTACCATT | 46 | 3388 |
| 876700 | N/A | N/A | 29725 | 29744 | CTAACAATAAAAGTTACGGT | 49 | 3389 |
| 876724 | N/A | N/A | 31409 | 31428 | AATTTGGTTATAAAAGAGTA | 94 | 3390 |
| 876748 | N/A | N/A | 33425 | 33444 | CAGGTCTTACTCAATAGTCA | 32 | 3391 |
| 876772 | N/A | N/A | 35704 | 35723 | AGCATCAGGTTCAAAAGCAA | 43 | 3392 |
| 876796 | N/A | N/A | 37927 | 37946 | CATTGTAGTTACTTTGTATA | 100 | 3393 |
| 876820 | N/A | N/A | 39204 | 39223 | AAACTATGAATAGGACACCA | 49 | 3394 |
| 876844 | N/A | N/A | 41563 | 41582 | CTGGAAGATTTTTATGCAAC | 66 | 3395 |
| 876868 | N/A | N/A | 45405 | 45424 | CTCTCACAATGAGACAGGAT | 48 | 3396 |
| 876892 | N/A | N/A | 47401 | 47420 | GGTGGAGAAATAAAAATATC | 153 | 3397 |
| 876916 | N/A | N/A | 49326 | 49345 | GATGTCCCTTGTCTATGAGT | 80 | 3398 |
| 876940 | N/A | N/A | 51672 | 51691 | GTCTTTGACCAAAATCTTCT | 53 | 3399 |
| 876964 | N/A | N/A | 54224 | 54243 | CTATCTTGGTTTAATCAGCC | 51 | 3400 |
| 876988 | N/A | N/A | 57012 | 57031 | ATATATTTTCATAGACTGAC | 73 | 3401 |
| 877012 | N/A | N/A | 59950 | 59969 | CATCTTGAAACAGGAAACCC | 90 | 3402 |
| 877036 | N/A | N/A | 62729 | 62748 | GCTTGAAAGTATAAAGAAAA | 92 | 3403 |
| 877060 | N/A | N/A | 64985 | 65004 | GCTAAATAAAGGATCTTGTT | 61 | 3404 |
| 877084 | N/A | N/A | 67063 | 67082 | TCTTAAGTGGGATACAAAAA | 77 | 3405 |
| 877108 | N/A | N/A | 69905 | 69924 | AATTACAACTTCAATATTTC | 117 | 3406 |
| 877132 | N/A | N/A | 72455 | 72474 | CAAAGTGAACCTGAGAATAA | 86 | 3407 |
| 877156 | N/A | N/A | 73937 | 73956 | TCTGTTTCCATTGCCTGCCC | 24 | 3408 |
| 877180 | N/A | N/A | 75325 | 75344 | ATTATTTTGCTTGCTCATTT | 62 | 3409 |
| 877204 | N/A | N/A | 78164 | 78183 | TATCTCAGTATCAGGATGCC | 36 | 3410 |
| 877228 | N/A | N/A | 81375 | 81394 | TACATAAACTTGCCTAATCT | 120 | 3411 |
| 877235 | N/A | N/A | 82381 | 82400 | ATGGAAATCTGGATTTATAG | 48 | 3412 |
| 877259 | N/A | N/A | 84939 | 84958 | TCAGAAAACAAAATCCTTCC | 70 | 3413 |
| 877283 | N/A | N/A | 87993 | 88012 | CATTAAAAAATACCCAAATT | 142 | 3414 |
| 877307 | N/A | N/A | 90438 | 90457 | TCAAACCATTATGCCAGAAT | 34 | 3415 |
| 877331 | N/A | N/A | 91722 | 91741 | AATGTGAAACAGACACGCTA | 53 | 3416 |
| 877355 | N/A | N/A | 94450 | 94469 | AATGTTTCAATATGCTCTTG | 22 | 3417 |
| 877379 | N/A | N/A | 95946 | 95965 | ATTTTAAGCCTCCAAGTTTC | 110 | 3418 |
| 877403 | N/A | N/A | 98420 | 98439 | CAAAATAAATGATACATGTC | 104 | 3419 |
| 877427 | N/A | N/A | 101435 | 101454 | CATCCTAATTTTTATTCTCA | 94 | 3420 |
| 877451 | N/A | N/A | 103549 | 103568 | AGCCAAAATGGCAACAGCTC | 52 | 3421 |
| 877475 | N/A | N/A | 105747 | 105766 | TCATTCCACTTTGATTGTGT | 40 | 3422 |
| 877499 | N/A | N/A | 108438 | 108457 | GGAATTTTCTTCAAATTTTG | 102 | 3423 |
| 877523 | N/A | N/A | 111233 | 111252 | TCATAGGCACAGACAGAGGT | 68 | 3424 |
| 877547 | N/A | N/A | 112873 | 112892 | ACTACAGTTGACCTATGGAC | 74 | 3425 |
| 877571 | N/A | N/A | 115802 | 115821 | ATTGCAAGCATAAACAGATT | 98 | 3426 |
| 877595 | N/A | N/A | 118045 | 118064 | ATGAATATTTTAACTATTTC | 65 | 3427 |
| 877619 | N/A | N/A | 119984 | 120003 | GCTATTCATGGCTCTGTTGT | 66 | 3428 |
| 877643 | N/A | N/A | 122352 | 122371 | GTTAGAATTTGGAATCACAG | 42 | 3429 |
| 877667 | N/A | N/A | 125287 | 125306 | CAAATGTGGAGTTCTAACAG | 106 | 3430 |
| 877691 | N/A | N/A | 128589 | 128608 | TGGACAAGGTTACTTGGGCA | 55 | 3431 |
| 877715 | N/A | N/A | 132782 | 132801 | TTTATAAATGTCTCAGCTAG | 72 | 3432 |
| 877739 | N/A | N/A | 135635 | 135654 | ATTGCTATAGCCACTACGGA | 102 | 3433 |
| 877763 | N/A | N/A | 140038 | 140057 | CTAGAACTCCAAAAGTCCTA | 76 | 3434 |
| 877787 | N/A | N/A | 141378 | 141397 | ACAAGCTAGACTATTGCAAT | 55 | 3435 |
| 877811 | N/A | N/A | 143863 | 143882 | GAATATATTTTCTTCACCAT | 62 | 3436 |
| 877835 | N/A | N/A | 145294 | 145313 | AAACTACCAATTAAAATTCC | 80 | 3437 |

TABLE 46

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 42 | 222 |
| 876029 | 733 | 752 | 18632 | 18651 | CACTTAACAATATCATATAA | 73 | 3438 |
| 876053 | 841 | 860 | 21672 | 21691 | CATTGCCACTCATGAGGACT | 29 | 3439 |
| 876077 | 1249 | 1268 | 29600 | 29619 | TGTTTTGGTACATAAGGAGA | 60 | 3440 |
| 876101 | 1483 | 1502 | 35430 | 35449 | TTTCAGCCACTTCAGGAGAA | 50 | 3441 |
| 876125 | 1702 | 1721 | 41935 | 41954 | TAACCATATTTAGCTTATGA | 56 | 3442 |

TABLE 46-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876149 | 2453 | 2472 | 62074 | 62093 | CTGTCACCTTTCCCAATGCT | 26 | 3443 |
| 876173 | 3064 | 3083 | 73600 | 73619 | CTAGTGATGTAATATATTCT | 32 | 3444 |
| 876197 | 3427 | 3446 | 76561 | 76580 | GTTTCTCTACCACATCAGTG | 38 | 3445 |
| 876221 | 3852 | 3871 | 82197 | 82216 | CAGTTTCTCTACTCTAGACC | 28 | 3446 |
| 876245 | 4315 | 4334 | 87219 | 87238 | GAGTACTATAGAATTCCTCA | 81 | 3447 |
| 876269 | 4741 | 4760 | 92164 | 92183 | CGGGAAATTCAATTGGCACA | 44 | 3448 |
| 876293 | 5071 | 5090 | 98219 | 98238 | GGAATTTTTCTAGGAGCTTA | 27 | 3449 |
| 876317 | 5451 | 5470 | 100440 | 100459 | GTGGTCCACAACTTGGCCCA | 72 | 152 |
| 876341 | 5745 | 5764 | 101383 | 101402 | TGGAGCTTGTTCAAATTCCA | 52 | 153 |
| 876365 | 6510 | 6529 | 129655 | 129674 | TTCAGCTGAATTCAAAATGT | 82 | 3450 |
| 876389 | 7174 | 7193 | 141535 | 141554 | CCACTGTTATGATGTTGGAA | 65 | 3451 |
| 876413 | 8085 | 8104 | 146254 | 146273 | ATTTCTAGAAAAATCGACAA | 115 | 3452 |
| 876437 | 8911 | 8930 | 147080 | 147099 | TGTCCTATCACAGGGAATTA | 81 | 3453 |
| 876461 | N/A | N/A | 4590 | 4609 | GTCTGTCAAGCCTCTCAACC | 79 | 3454 |
| 876485 | N/A | N/A | 7136 | 7155 | TATCAAACCATTTTGCTTTT | 79 | 3455 |
| 876509 | N/A | N/A | 9076 | 9095 | CAGATTTCTCTAGAATGAAT | 67 | 3456 |
| 876533 | N/A | N/A | 12031 | 12050 | TGTGTCTATCTTCTTCACAA | 119 | 3457 |
| 876557 | N/A | N/A | 14909 | 14928 | AGACTCTTAGTGCATGCCAT | 46 | 3458 |
| 876581 | N/A | N/A | 17076 | 17095 | CCTTAGAAACACAGTAAACT | 72 | 3459 |
| 876605 | N/A | N/A | 19554 19584 | 19573 19603 | AAAACAGAATATGAACCATT | 48 | 3460 |
| 876629 | N/A | N/A | 21340 | 21359 | GGAAAAGTACTGAAAATGAA | 134 | 3461 |
| 876653 | N/A | N/A | 24869 | 24888 | CAGACTCTCTGCAAGGTAAG | 88 | 3462 |
| 876677 | N/A | N/A | 27495 | 27514 | CTTAAAGGAATAGTGCTTAG | 71 | 3463 |
| 876701 | N/A | N/A | 29875 | 29894 | AATTACCAAATGACCCTTGA | 73 | 3464 |
| 876725 | N/A | N/A | 31897 | 31916 | TGGTGTTTACTATGGGTTCC | 28 | 3465 |
| 876749 | N/A | N/A | 33427 | 33446 | TGCAGGTCTTACTCAATAGT | 75 | 3466 |
| 876773 | N/A | N/A | 35778 | 35797 | CACACAATAATTAGAAAAAC | 106 | 3467 |
| 876797 | N/A | N/A | 37999 | 38018 | TCATGGCAACAAAAATAGAA | 129 | 3468 |
| 876821 | N/A | N/A | 39337 | 39356 | TGTCAACTTTAAGGATAATC | 35 | 3469 |
| 876845 | N/A | N/A | 41680 | 41699 | TAAATATAATGTGTAAGAAT | 117 | 3470 |
| 876869 | N/A | N/A | 45530 | 45549 | CACCAACACTCACCATGAAT | 62 | 3471 |
| 876893 | N/A | N/A | 47579 | 47598 | CCCTCAGGGACCTCTACTGA | 59 | 3472 |
| 876917 | N/A | N/A | 49662 | 49681 | ATTTATCAGTGTCTACTTAG | 68 | 3473 |
| 876941 | N/A | N/A | 51782 | 51801 | TTCATTTAGATGATGTTTTG | 95 | 3474 |
| 876965 | N/A | N/A | 54337 | 54356 | ACTCTACTATAGAGATTCTA | 95 | 3475 |
| 876989 | N/A | N/A | 57276 | 57295 | ATTTAATAATGTGTATTAAA | 129 | 3476 |
| 877013 | N/A | N/A | 59957 | 59976 | TACAAACCATCTTGAAACAG | 98 | 3477 |
| 877037 | N/A | N/A | 62733 | 62752 | ATGAGCTTGAAAGTATAAAG | 83 | 3478 |
| 877061 | N/A | N/A | 65104 | 65123 | GTATCAGTGTCCTCACCTGG | 84 | 3479 |
| 877085 | N/A | N/A | 67064 | 67083 | TTCTTAAGTGGGATACAAAA | 81 | 3480 |
| 877109 | N/A | N/A | 69996 | 70015 | ATAGTCCTTAATGTTTGCAC | 46 | 3481 |
| 877133 | N/A | N/A | 72458 | 72477 | TTTCAAAGTGAACCTGAGAA | 83 | 3482 |
| 877157 | N/A | N/A | 73938 | 73957 | ATCTGTTTCCATTGCCTGCC | 69 | 3483 |
| 877181 | N/A | N/A | 75378 | 75397 | CCTTGTCACAGTCTCTTCCA | 56 | 3484 |
| 877205 | N/A | N/A | 78262 | 78281 | AAAACCATTAAATGATTAAT | 148 | 3485 |
| 877229 | N/A | N/A | 81468 | 81487 | AACACACTCAAGATCCAATT | 94 | 3486 |
| 877236 | N/A | N/A | 82634 | 82653 | ATCACACATAATTTGAAATG | 91 | 3487 |
| 877260 | N/A | N/A | 85112 | 85131 | AGTATAATACACTGAAAGCT | 86 | 3488 |
| 877284 | N/A | N/A | 88019 | 88038 | AGCTGTAAAAAAGTTAATAA | 80 | 3489 |
| 877308 | N/A | N/A | 90441 | 90460 | TTTTCAAACCATTATGCCAG | 77 | 3490 |
| 877332 | N/A | N/A | 91728 | 91747 | AAACTTAATGTGAAACAGAC | 77 | 3491 |
| 877356 | N/A | N/A | 94452 | 94471 | GCAATGTTTCAATATGCTCT | 13 | 3492 |
| 877380 | N/A | N/A | 96049 | 96068 | GAATGAAGCCAAGTGAATAA | 82 | 3493 |
| 877404 | N/A | N/A | 98444 | 98463 | AGTGTCAGATGCAATGTTTT | 92 | 3494 |
| 877428 | N/A | N/A | 101447 | 101466 | AGGAGAAAATTACATCCTAA | 81 | 3495 |
| 877452 | N/A | N/A | 104028 | 104047 | AAGAGGAAATGTACCCTGTG | 77 | 3496 |
| 877476 | N/A | N/A | 105776 | 105795 | CTCTCTCTCTTGCAAAATTA | 74 | 3497 |
| 877500 | N/A | N/A | 108554 | 108573 | AATTCAAAAGGTCAAATTTT | 105 | 3498 |
| 877524 | N/A | N/A | 111239 | 111258 | TTGTTTTCATAGGCACAGAC | 35 | 3499 |
| 877548 | N/A | N/A | 112899 | 112918 | TTCAGTAATAAAAAGCTGGT | 63 | 3500 |
| 877572 | N/A | N/A | 115808 | 115827 | CAAGGAATTGCAAGCATAAA | 69 | 3501 |
| 877596 | N/A | N/A | 118216 | 118235 | GTCTAATATTACACAGCAAA | 55 | 3502 |
| 877620 | N/A | N/A | 119990 | 120009 | ATATTTGCTATTCATGGCTC | 54 | 3503 |
| 877644 | N/A | N/A | 122379 | 122398 | AGCATATTTTTCTTGATAA | 40 | 3504 |
| 877668 | N/A | N/A | 125297 | 125316 | TAAAAATCACCAAATGTGGA | 85 | 3505 |
| 877692 | N/A | N/A | 128599 | 128618 | GATAATATGGTGGACAAGGT | 38 | 3506 |
| 877716 | N/A | N/A | 132876 | 132895 | GATTCATTGATCTGAGGAGA | 55 | 3507 |
| 877740 | N/A | N/A | 135638 | 135657 | TAAATTGCTATAGCCACTAC | 72 | 3508 |
| 877764 | N/A | N/A | 140071 | 140090 | TTGCCGACCTAGGACTAAAA | 53 | 3509 |
| 877788 | N/A | N/A | 141480 | 141499 | AAAAAATAGAAAGTCATCAC | 128 | 3510 |

TABLE 46-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877812 | N/A | N/A | 143888 | 143907 | TTCCTCTTTCACATATACTT | 77 | 3511 |
| 877836 | N/A | N/A | 145295 | 145314 | TAAACTACCAATTAAAATTC | 139 | 3512 |

TABLE 47

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 31 | 222 |
| 876030 | 734 | 753 | 18633 | 18652 | GCACTTAACAATATCATATA | 34 | 3513 |
| 876054 | 846 | 865 | 21677 | 21696 | CCTGACATTGCCACTCATGA | 38 | 3514 |
| 876078 | 1293 | 1312 | N/A | N/A | AGCTGGGAAATGGCCATCTT | 64 | 3515 |
| 876102 | 1484 | 1503 | 35431 | 35450 | CTTTCAGCCACTTCAGGAGA | 62 | 3516 |
| 876126 | 1704 | 1723 | 41937 | 41956 | TTTAACCATATTTAGCTTAT | 58 | 3517 |
| 876150 | 2454 | 2473 | 62075 | 62094 | GCTGTCACCTTTCCCAATGC | 31 | 3518 |
| 876174 | 3069 | 3088 | 73605 | 73624 | AAGGTCTAGTGATGTAATAT | 43 | 3519 |
| 876198 | 3457 | 3476 | N/A | N/A | TTTTATTTCCTTCTAAAATG | 113 | 3520 |
| 876222 | 3853 | 3872 | 82198 | 82217 | GCAGTTTCTCTACTCTAGAC | 25 | 3521 |
| 876246 | 4316 | 4335 | 87220 | 87239 | TGAGTACTATAGAATTCCTC | 46 | 3522 |
| 876270 | 4751 | 4770 | 92174 | 92193 | CGGTCAATTACGGGAAATTC | 45 | 3523 |
| 876294 | 5073 | 5092 | 98221 | 98240 | CTGGAATTTTTCTAGGAGCT | 13 | 3524 |
| 876318 | 5452 | 5471 | 100441 | 100460 | TGTGGTCCACAACTTGGCCC | 43 | 3525 |
| 876342 | 5787 | 5806 | 106478 | 106497 | TCGGTAAACTGATCCAAAAC | 63 | 3526 |
| 876366 | 6515 | 6534 | 129660 | 129679 | ACTAATTCAGCTGAATTCAA | 67 | 3527 |
| 876390 | 7179 | 7198 | 141540 | 141559 | TACCACCACTGTTATGATGT | 45 | 3528 |
| 876414 | 8090 | 8109 | 146259 | 146278 | TGCAGATTTCTAGAAAAATC | 43 | 3529 |
| 876438 | 8978 | 8997 | 147147 | 147166 | TATAAATAAATTTAAAGTTT | 96 | 3530 |
| 876462 | N/A | N/A | 4609 | 4628 | AAAGATTGAGATGCCTCATG | 73 | 3531 |
| 876486 | N/A | N/A | 7222 | 7241 | GTAGGAGACCCCTTTCTACA | 67 | 3532 |
| 876510 | N/A | N/A | 9202 | 9221 | AATGAAGCTAGAATAATAGA | 118 | 3533 |
| 876534 | N/A | N/A | 12064 | 12083 | GAGTGATCTAATACACTCCA | 93 | 3534 |
| 876558 | N/A | N/A | 14962 | 14981 | CCGTCAAAAAAAAAATACCT | 129 | 3535 |
| 876582 | N/A | N/A | 17310 | 17329 | CTCGCTGCAATACACTTTGT | 66 | 3536 |
| 876606 | N/A | N/A | 19555 19585 | 19574 19604 | CAAAACAGAATATGAACCAT | 84 | 3537 |
| 876630 | N/A | N/A | 21645 | 21664 | TATTGCCTGAATTTAAAGAG | 81 | 3538 |
| 876654 | N/A | N/A | 25038 | 25057 | ACTTTTAAATGCATTGTTGT | 72 | 3539 |
| 876678 | N/A | N/A | 27571 | 27590 | TTTAAAGTTGAAACTCTTAA | 124 | 3540 |
| 876702 | N/A | N/A | 29941 | 29960 | TGAATTAATATGGCATTTTA | 86 | 3541 |
| 876726 | N/A | N/A | 31920 | 31939 | AAACAGAGGAGGAAAGTGAT | 126 | 3542 |
| 876750 | N/A | N/A | 33456 | 33475 | TCAGAGGCAAAAAACAATAT | 67 | 3543 |
| 876774 | N/A | N/A | 35835 | 35854 | CGTTGTGAAAGAGCAAAATT | 50 | 3544 |
| 876798 | N/A | N/A | 38037 | 38056 | GTACAATTCAAACAAGAGAA | 100 | 3545 |
| 876822 | N/A | N/A | 39461 | 39480 | GAAATACTGTATTCAAAACT | 73 | 3546 |
| 876846 | N/A | N/A | 41819 | 41838 | GACTGTTACTTTCTAGAAAT | 93 | 3547 |
| 876870 | N/A | N/A | 45583 | 45602 | GGCTAACTGGAACCAGTTAT | 48 | 3548 |
| 876894 | N/A | N/A | 47597 | 47616 | GACTCTGCTTGTTGTAGTCC | 68 | 3549 |
| 876918 | N/A | N/A | 49701 | 49720 | TAATGTATTGCATTGGTGCT | 62 | 3550 |
| 876942 | N/A | N/A | 51819 | 51838 | TAAAAATTATAGTGCCATCC | 51 | 3551 |
| 876966 | N/A | N/A | 54764 | 54783 | AATGCTACAGCAGAGCAGGC | 45 | 3552 |
| 876990 | N/A | N/A | 57307 | 57326 | AACTATTGGCAAACATAGTA | 76 | 3553 |
| 877014 | N/A | N/A | 59967 | 59986 | CATACAGACCTACAAACCAT | 69 | 3554 |
| 877038 | N/A | N/A | 62754 | 62773 | CATAATATGTACAAAATACA | 100 | 3555 |
| 877062 | N/A | N/A | 65304 | 65323 | AGTGATCCTGAATAATTAAC | 94 | 3556 |
| 877086 | N/A | N/A | 67065 | 67084 | TTTCTTAAGTGGGATACAAA | 66 | 3557 |
| 877110 | N/A | N/A | 70097 | 70116 | AATTCTTCCAGAGGAAGAAA | 123 | 3558 |
| 877134 | N/A | N/A | 72483 | 72502 | ATTGGAGAATAGGTTAGAAC | 64 | 3559 |
| 877158 | N/A | N/A | 73939 | 73958 | GATCTGTTTCCATTGCCTGC | 44 | 3560 |
| 877182 | N/A | N/A | 75408 | 75427 | TGTCCAGTCATTGAATGCCG | 30 | 3561 |
| 877206 | N/A | N/A | 78354 | 78373 | CTTTTAATAAAAGTGATGAT | 115 | 3562 |
| 877230 | N/A | N/A | 81470 | 81489 | ACAACACACTCAAGATCCAA | 68 | 3563 |
| 877237 | N/A | N/A | 82682 | 82701 | AACAGTTAAGAATAATTTGA | 122 | 3564 |

TABLE 47-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877261 | N/A | N/A | 85276 | 85295 | CACTATTTGAAAAAATGTCT | 81 | 3565 |
| 877285 | N/A | N/A | 88051 | 88070 | GACTGCCACTGTACTATTTG | 45 | 3566 |
| 877309 | N/A | N/A | 90454 | 90473 | GCAATCAAATGAGTTTTCAA | 66 | 3567 |
| 877333 | N/A | N/A | 92392 | 92411 | ATCAGTGGCCTATTAAAGAA | 98 | 3568 |
| 877357 | N/A | N/A | 94453 | 94472 | TGCAATGTTTCAATATGCTC | 34 | 3569 |
| 877381 | N/A | N/A | 96103 | 96122 | CAATACTCCAAAAACATGCA | 52 | 3570 |
| 877405 | N/A | N/A | 98870 | 98889 | TTAGTTATGCATAGACAAAT | 49 | 3571 |
| 877429 | N/A | N/A | 101479 | 101498 | ATATAATTATGAAATCTATT | 95 | 3572 |
| 877453 | N/A | N/A | 104214 | 104233 | GAGTATGGATTGTCATGTCT | 63 | 3573 |
| 877477 | N/A | N/A | 105993 | 106012 | ACAAAAAGTCTTTTTGAGGC | 48 | 3574 |
| 877501 | N/A | N/A | 108768 | 108787 | TTACTACTATATATATATCA | 72 | 3575 |
| 877525 | N/A | N/A | 111286 | 111305 | CATGTCAGTTGGTTAGAACT | 62 | 3576 |
| 877549 | N/A | N/A | 113456 | 113475 | TATTACTACTTGCTATGAGG | 55 | 3577 |
| 877573 | N/A | N/A | 116029 | 116048 | ATGAGCTCTCTAGGCAGACA | 40 | 3578 |
| 877597 | N/A | N/A | 118217 | 118236 | AGTCTAATATTACACAGCAA | 41 | 3579 |
| 877621 | N/A | N/A | 120065 | 120084 | TTTTTCCAGGTGGAAATATA | 120 | 3580 |
| 877645 | N/A | N/A | 122402 | 122421 | ATTCAAAAACTATTTAAATG | 118 | 3581 |
| 877669 | N/A | N/A | 125328 | 125347 | TAATGAGTACACAGTAATTC | 54 | 3582 |
| 877693 | N/A | N/A | 128602 | 128621 | TCAGATAATATGGTGGACAA | 53 | 3583 |
| 877717 | N/A | N/A | 132890 | 132909 | AGAGGCCCTACAAAGATTCA | 92 | 3584 |
| 877741 | N/A | N/A | 136288 | 136307 | TCAACAATATAGAGAGGATC | 113 | 3585 |
| 877765 | N/A | N/A | 140272 | 140291 | TGTATTTAATAGAAAATAGT | 114 | 3586 |
| 877789 | N/A | N/A | 141697 | 141716 | TGAAGTGCAAAGATAATTCT | 129 | 3587 |
| 877813 | N/A | N/A | 144037 | 144056 | CTGAGACAACCTATTGAGAG | 67 | 3588 |
| 877837 | N/A | N/A | 145342 | 145361 | CATATCACTTGTAATTTTGA | 43 | 3589 |

TABLE 48

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 18 | 222 |
| 876031 | 736 | 755 | 18635 | 18654 | ACGCACTTAACAATATCATA | 22 | 3590 |
| 876055 | 867 | 886 | 21698 | 21717 | TTCCACCACAATATTATAAC | 42 | 3591 |
| 876079 | 1298 | 1317 | N/A | N/A | CTATGAGCTGGGAAATGGCC | 62 | 3592 |
| 876103 | 1485 | 1504 | 35432 | 35451 | ACTTTCAGCCACTTCAGGAG | 38 | 3593 |
| 876127 | 1723 | 1742 | 41956 | 41975 | CATTCTTGAAACACTGTTTT | 39 | 3594 |
| 876151 | 2456 | 2475 | 62077 | 62096 | TGGCTGTCACCTTTCCCAAT | 33 | 3595 |
| 876175 | 3153 | 3172 | 73689 | 73708 | CTCCAGCTTTTCAAGATGCT | 33 | 3596 |
| 876199 | 3529 | 3548 | 77278 | 77297 | ATGAAATGTGGTTCTTACTA | 35 | 3597 |
| 876223 | 3854 | 3873 | 82199 | 82218 | TGCAGTTTCTCTACTCTAGA | 23 | 3598 |
| 876247 | 4317 | 4336 | 87221 | 87240 | ATGAGTACTATAGAATTCCT | 48 | 3599 |
| 876271 | 4753 | 4772 | 92176 | 92195 | TCCGGTCAATTACGGGAAAT | 36 | 3600 |
| 876295 | 5074 | 5093 | 98222 | 98241 | TCTGGAATTTTTCTAGGAGC | 26 | 150 |
| 876319 | 5454 | 5473 | 100443 | 100462 | AATGTGGTCCACAACTTGGC | 49 | 3601 |
| 876343 | 5792 | 5811 | 106483 | 106502 | GCTGCTCGGTAAACTGATCC | 46 | 3602 |
| 876367 | 6601 | 6620 | 129746 | 129765 | TGCTTGCATTCCTGCTGTTG | 43 | 3603 |
| 876391 | 7218 | 7237 | 141579 | 141598 | AACAGGGCTATTTGCTTAG | 54 | 3604 |
| 876415 | 8131 | 8150 | 146300 | 146319 | TACATTACATGGGAAACTGT | 43 | 3605 |
| 876439 | 9021 | 9040 | 147190 | 147209 | AATACAGAAAATCTTTCATC | 120 | 3606 |
| 876463 | N/A | N/A | 4967 | 4986 | ATCAGGCACTTCTGAACACC | 51 | 3607 |
| 876487 | N/A | N/A | 7241 | 7260 | AGTGAGTATTAAAATGTCAG | 47 | 3608 |
| 876511 | N/A | N/A | 9214 | 9233 | TGCTCCCAAGTAATGAAGC | 65 | 3609 |
| 876535 | N/A | N/A | 12417 | 12436 | GATTTTAATCCCTATGTTAT | 115 | 3610 |
| 876559 | N/A | N/A | 15046 | 15065 | ACTTCAATATATTCCAGTGT | 54 | 3611 |
| 876583 | N/A | N/A | 17338 | 17357 | TGCTATTCTGACTTTTGACA | 87 | 3612 |
| 876607 | N/A | N/A | 19605 | 19624 | GTTAATGGTCACTTACAAAA | 32 | 3613 |
| 876631 | N/A | N/A | 21986 | 22005 | GACACTCCTTTTAAAAGTCC | 33 | 3614 |
| 876655 | N/A | N/A | 25054 | 25073 | TTCAGCAACCACTCTCACTT | 60 | 3615 |
| 876679 | N/A | N/A | 27604 | 27623 | TTCATTGTGTAAAATAACTT | 95 | 3616 |
| 876703 | N/A | N/A | 29976 | 29995 | ATCACAGATGGCTCTGCAAT | 56 | 3617 |
| 876727 | N/A | N/A | 32024 | 32043 | ATAATAGACAATTTTACCAG | 33 | 3618 |

TABLE 48-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876751 | N/A | N/A | 33545 | 33564 | AGAACATTTTACACACTATC | 52 | 3619 |
| 876775 | N/A | N/A | 35950 | 35969 | CTATATAATCTTAGCATCTC | 86 | 3620 |
| 876799 | N/A | N/A | 38144 | 38163 | CATTGAGGTAAATGAGTACA | 83 | 3621 |
| 876823 | N/A | N/A | 39741 | 39760 | TTGATACCTAGAATGATACG | 71 | 3622 |
| 876847 | N/A | N/A | 42026 | 42045 | ATAGTATAAATACAGAAAAC | 84 | 3623 |
| 876871 | N/A | N/A | 45585 | 45604 | TTGGCTAACTGGAACCAGTT | 63 | 3624 |
| 876895 | N/A | N/A | 47882 | 47901 | GGAAGGAAAAAACGAATACC | 61 | 3625 |
| 876919 | N/A | N/A | 49713 | 49732 | ATCTTGAAATAGTAATGTAT | 67 | 3626 |
| 876943 | N/A | N/A | 52094 | 52113 | TGGGACTTGAATATAAATGT | 97 | 3627 |
| 876967 | N/A | N/A | 54851 | 54870 | TTGATAAGCAAAGTAGCCTT | 34 | 3628 |
| 876991 | N/A | N/A | 57309 | 57328 | TAAACTATTGGCAAACATAG | 79 | 3629 |
| 877015 | N/A | N/A | 60005 | 60024 | AGGTGATTTATGTTTTACTC | 56 | 3630 |
| 877039 | N/A | N/A | 62783 | 62802 | TCAGAAGATGGTAACTTACC | 85 | 3631 |
| 877063 | N/A | N/A | 65433 | 65452 | TAAGAGATACACCAGCAACT | 91 | 3632 |
| 877087 | N/A | N/A | 67067 | 67086 | GGTTTCTTAAGTGGGATACA | 45 | 3633 |
| 877111 | N/A | N/A | 70265 | 70284 | TACATAAGAAGAAATTTAAA | 105 | 3634 |
| 877135 | N/A | N/A | 72531 | 72550 | ATTAACACAAAACAACCCTC | 63 | 3635 |
| 877159 | N/A | N/A | 73941 | 73960 | CAGATCTGTTTCCATTGCCT | 23 | 3636 |
| 877183 | N/A | N/A | 75798 | 75817 | AGCAAACCCCTACTTACACA | 37 | 3637 |
| 877207 | N/A | N/A | 78361 | 78380 | TCTACAACTTTTAATAAAAG | 85 | 3638 |
| 877231 | N/A | N/A | 81545 | 81564 | AAAGATAAATTTACACATAT | 76 | 3639 |
| 877238 | N/A | N/A | 82750 | 82769 | AGAATTTTTATCCTTATACT | 77 | 3640 |
| 877262 | N/A | N/A | 85277 | 85296 | CCACTATTTGAAAAAATGTC | 41 | 3641 |
| 877286 | N/A | N/A | 88222 | 88241 | ATTCACTCCTAAATAAAATA | 95 | 3642 |
| 877310 | N/A | N/A | 90580 | 90599 | ATGATCTCTAATAGATTAAA | 76 | 3643 |
| 877334 | N/A | N/A | 92439 | 92458 | ACATGATTTGTCATGAACAC | 19 | 3644 |
| 877358 | N/A | N/A | 94604 | 94623 | TAAGTGCTCTGGGTCACACT | 53 | 3645 |
| 877382 | N/A | N/A | 96108 | 96127 | AGCACCAATACTCCAAAAAC | 67 | 3646 |
| 877406 | N/A | N/A | 98871 | 98890 | ATTAGTTATGCATAGACAAA | 83 | 3647 |
| 877430 | N/A | N/A | 101490 | 101509 | AATCTATGACAATATAATTA | 102 | 3648 |
| 877454 | N/A | N/A | 104219 | 104238 | ATATGGAGTATGGATTGTCA | 46 | 3649 |
| 877478 | N/A | N/A | 106035 | 106054 | ACTAGTTTTTATTCTACCTT | 90 | 3650 |
| 877502 | N/A | N/A | 108861 | 108880 | CTAACATATACTCTTGGAGC | 44 | 3651 |
| 877526 | N/A | N/A | 111304 | 111323 | AATCTTTTTTTTAATGCCCA | 61 | 3652 |
| 877550 | N/A | N/A | 113493 | 113512 | TGATGGGTTCTAGAGCAGAA | 38 | 3653 |
| 877574 | N/A | N/A | 116095 | 116114 | GCTAACACTTCATGACACAC | 49 | 3654 |
| 877598 | N/A | N/A | 118289 | 118308 | AGCATCAAAAATTCTGTGCT | 51 | 3655 |
| 877622 | N/A | N/A | 120141 | 120160 | GTGGTCCAGTCCACCTTCAT | 61 | 3656 |
| 877646 | N/A | N/A | 122515 | 122534 | TTATGCTTCCCTTCTTAGAA | 63 | 3657 |
| 877670 | N/A | N/A | 125342 | 125361 | AAAACATTCCAGGATAATGA | 52 | 3658 |
| 877694 | N/A | N/A | 128625 | 128644 | TAAAACATGACAAGAGTTCT | 124 | 3659 |
| 877718 | N/A | N/A | 133009 | 133028 | TCTTAATTTGGTAGTTAGAT | 28 | 3660 |
| 877742 | N/A | N/A | 136525 | 136544 | GATGAAAGTAGGCCCCACTC | 70 | 3661 |
| 877766 | N/A | N/A | 140319 | 140338 | TGTCAGAGAGCCACTACGCT | 57 | 3662 |
| 877790 | N/A | N/A | 141746 | 141765 | TTCTCTATTCAGAGGCAGAA | 61 | 3663 |
| 877814 | N/A | N/A | 144077 | 144096 | TTCAACTAGAGAATGCAACA | 58 | 3664 |
| 877838 | N/A | N/A | 145702 | 145721 | AAAGATCCATCATAAAACAT | 111 | 3665 |

TABLE 49

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 28 | 222 |
| 876027 | 730 | 749 | 18629 | 18648 | TTAACAATATCATATAATCT | 6 | 3666 |
| 876051 | 838 | 857 | 21669 | 21688 | TGCCACTCATGAGGACTTCC | 39 | 3667 |
| 876075 | 1237 | 1256 | 29588 | 29607 | TAAGGAGATTATTTAGTGCC | 61 | 3668 |
| 876099 | 1481 | 1500 | 35428 | 35447 | TCAGCCACTTCAGGAGAATG | 53 | 3669 |
| 876123 | 1700 | 1719 | 41933 | 41952 | ACCATATTTAGCTTATGATG | 25 | 3670 |
| 876147 | 2450 | 2469 | 62071 | 62090 | TCACCTTTCCCAATGCTTAT | 77 | 3671 |
| 876171 | 2936 | 2955 | 72960 | 72979 | AAATCTTCATGATCAAAAAT | 85 | 3672 |
| 876195 | 3338 | 3357 | 76472 | 76491 | GTAGGATCTAAAACCACTGA | 22 | 3673 |

TABLE 49-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 876219 | 3840 | 3859 | 82185 | 82204 | TCTAGACCATAAATATGCTT | 29 | 3674 |
| 876243 | 4312 | 4331 | 87216 | 87235 | TACTATAGAATTCCTCACGA | 58 | 3675 |
| 876267 | 4735 | 4754 | 92158 | 92177 | ATTCAATTGGCACATTTTA | 49 | 3676 |
| 876291 | 5069 | 5088 | 98217 | 98236 | AATTTTTCTAGGAGCTTAAA | 107 | 3677 |
| 876315 | 5448 | 5467 | 100437 | 100456 | GTCCACAACTTGGCCCAAAA | 30 | 3678 |
| 876339 | 5694 | 5713 | 101332 | 101351 | CAGGTCAGCCAAAATCAAGT | 37 | 3679 |
| 876363 | 6466 | 6485 | 126582 | 126601 | TTTCTTGAGGATTTTCTTTC | 75 | 3680 |
| 876387 | 7046 | 7065 | 137450 | 137469 | ATTACATTTCTTTCCGTTGA | 53 | 3681 |
| 876411 | 7998 | 8017 | 146167 | 146186 | AAATTATCGGCCTTATAAAT | 96 | 3682 |
| 876435 | 8867 | 8886 | 147036 | 147055 | GGCCAAAGAATTTACCGAAA | 48 | 3683 |
| 876459 | N/A | N/A | 4386 | 4405 | TTTTTAAGGCCCCCTTTAAA | 95 | 3684 |
| 876483 | N/A | N/A | 7028 | 7047 | TTAGGTCTGTCACAAGCTCT | 50 | 3685 |
| 876507 | N/A | N/A | 8960 | 8979 | CAGTCTGTTTACAAGATGCC | 36 | 3686 |
| 876531 | N/A | N/A | 11871 | 11890 | TGAACAGTTGGTTTGTACAG | 67 | 3687 |
| 876555 | N/A | N/A | 14783 | 14802 | GGACTGATGAGGACAATTCA | 88 | 3688 |
| 876579 | N/A | N/A | 16929 | 16948 | AGGTGATCTATCCCATTCTG | 67 | 3689 |
| 876603 | N/A | N/A | 19458 | 19477 | GTGGCTAAATTTCAAAGCCT | 70 | 3690 |
| 876627 | N/A | N/A | 21316 | 21335 | TGGAAATGTAATGTATTGGT | 56 | 3691 |
| 876651 | N/A | N/A | 24654 | 24673 | GCAGTTGGTTTAGACTCCCC | 44 | 3692 |
| 876675 | N/A | N/A | 27306 | 27325 | AGGAAAAACTTTACCTGATA | 83 | 3693 |
| 876699 | N/A | N/A | 29666 | 29685 | ATTTTCTATCATATAAAATC | 93 | 3694 |
| 876723 | N/A | N/A | 31361 | 31380 | TAAAATTTTGTATATGTCAT | 146 | 3695 |
| 876747 | N/A | N/A | 33424 | 33443 | AGGTCTTACTCAATAGTCAC | 34 | 3696 |
| 876771 | N/A | N/A | 35347 | 35366 | CTGAAATTAACTGAGATTTT | 84 | 3697 |
| 876795 | N/A | N/A | 37878 | 37897 | TATAAAAATTAATCTAAGTG | 85 | 3698 |
| 876819 | N/A | N/A | 39165 | 39184 | CTGATTGAATAGCCACCAGA | 110 | 3699 |
| 876843 | N/A | N/A | 41526 | 41545 | AAGCTCAGAGTTACTTGGAC | 52 | 3700 |
| 876867 | N/A | N/A | 45354 | 45373 | GACGCGGCAACTGTGGCAAT | 34 | 3701 |
| 876891 | N/A | N/A | 47370 | 47389 | ATGAATGATTACCATGTAAG | 87 | 3702 |
| 876915 | N/A | N/A | 49237 | 49256 | TCCAACATCATATGACTGAT | 62 | 3703 |
| 876939 | N/A | N/A | 51525 | 51544 | CAGTTTCTCACCCTGTGTCC | 50 | 3704 |
| 876963 | N/A | N/A | 54026 | 54045 | AGTTACAAAAAATATTTCCT | 79 | 3705 |
| 876987 | N/A | N/A | 56923 | 56942 | GAATTATATTTTGAAGGGAG | 66 | 3706 |
| 877011 | N/A | N/A | 59932 | 59951 | CCATTTTATATTCTCTATTA | 85 | 3707 |
| 877035 | N/A | N/A | 62618 | 62637 | TACATGTAAGCATATAAAAA | 116 | 3708 |
| 877059 | N/A | N/A | 64920 | 64939 | CCTGATGGAATTTCAAAGTT | 89 | 3709 |
| 877083 | N/A | N/A | 67061 | 67080 | TTAAGTGGGATACAAAAAGC | 65 | 3710 |
| 877107 | N/A | N/A | 69892 | 69911 | ATATTTCTCTATCAAATACA | 79 | 3711 |
| 877131 | N/A | N/A | 72432 | 72451 | GGCTCCCAATTTCCTCAACT | 25 | 3712 |
| 877155 | N/A | N/A | 73935 | 73954 | TGTTTCCATTGCCTGCCCTC | 62 | 3713 |
| 877179 | N/A | N/A | 75295 | 75314 | AATTGAAGGATTACCAAGTT | 67 | 3714 |
| 877203 | N/A | N/A | 78122 | 78141 | TGCATGTTTAGTTTAAGACT | 65 | 3715 |
| 877227 | N/A | N/A | 81187 | 81206 | GTTTTTACACAATGATCCAC | 57 | 3716 |
| 877234 | N/A | N/A | 82324 | 82343 | TCATGAAATTGGTATTTAGA | 73 | 3717 |
| 877258 | N/A | N/A | 84886 | 84905 | AGAGATTTTAGGCAGAAGAG | 68 | 3718 |
| 877282 | N/A | N/A | 87961 | 87980 | TGTATGCAGCCAATTACATG | 81 | 3719 |
| 877306 | N/A | N/A | 90436 | 90455 | AAACCATTATGCCAGAATGC | 54 | 3720 |
| 877330 | N/A | N/A | 91673 | 91692 | CTTTTGGATATTATTATATT | 76 | 3721 |
| 877354 | N/A | N/A | 94268 | 94287 | AATAATTTTAGGAACTCGGG | 85 | 3722 |
| 877378 | N/A | N/A | 95893 | 95912 | ACATTATCTTGACTTTATCA | 41 | 3723 |
| 877402 | N/A | N/A | 98345 | 98364 | TAGACTACAGTTAGTTTGAC | 49 | 3724 |
| 877426 | N/A | N/A | 101401 | 101420 | ATTACCTAGGAGAAACTCTG | 66 | 3725 |
| 877450 | N/A | N/A | 103499 | 103518 | TTCTGTAAATGAACATGGGA | 62 | 3726 |
| 877474 | N/A | N/A | 105725 | 105744 | CTCTCCTGTTCAGAAACAAA | 114 | 3727 |
| 877498 | N/A | N/A | 108194 | 108213 | GAGGGCGAGGAAACTAACTC | 66 | 3728 |
| 877522 | N/A | N/A | 111004 | 111023 | CACCATTCCCTTAGTTTGCC | 38 | 3729 |
| 877546 | N/A | N/A | 112841 | 112860 | AAGTGCATGAGTCCACATAT | 81 | 3730 |
| 877570 | N/A | N/A | 115680 | 115699 | TAGAGTCAAGGACCTGGTGG | 62 | 3731 |
| 877594 | N/A | N/A | 117784 | 117803 | CTTCTGTTTGAGTATATAAT | 83 | 3732 |
| 877618 | N/A | N/A | 119917 | 119936 | TTAGAGTTGCATATGGTTTA | 41 | 3733 |
| 877642 | N/A | N/A | 122346 | 122365 | ATTTGGAATCACAGGCTCTT | 66 | 3734 |
| 877666 | N/A | N/A | 125137 | 125156 | TTATGCACTAAACAAAAAAA | 106 | 3735 |
| 877690 | N/A | N/A | 128267 | 128286 | TGGGACCCCAAAGGACTGCA | 54 | 3736 |
| 877714 | N/A | N/A | 132254 | 132273 | TTTATTTAATTTTCAGCAAT | 78 | 3737 |
| 877738 | N/A | N/A | 135518 | 135537 | ATATCAAAGGGATTCCTATA | 113 | 3738 |
| 877762 | N/A | N/A | 139971 | 139990 | CCTCTCAGTCGGTGTGTACT | 102 | 3739 |
| 877786 | N/A | N/A | 141372 | 141391 | TAGACTATTGCAATTATTTC | 87 | 3740 |
| 877810 | N/A | N/A | 143858 | 143877 | TATTTCTTCACCATGTTCA | 97 | 3741 |
| 877834 | N/A | N/A | 145268 | 145287 | TACCATATGTAATATTTTCT | 57 | 3742 |

TABLE 50

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 780241 | 3714 | 3733 | 82059 | 82078 | GCTCATATCTAAAGACCGCA | 24 | 222 |
| 803629 | N/A | N/A | 81591 | 81610 | AAGCCATAGTGTTTGAAGGA | 34 | 1791 |
| 876014 | 340 | 359 | 87848 | 87867 | CCTGCTGCACACTCGCGACT | 48 | 3743 |
| 876038 | 823 | 842 | 3731 | 3750 | CTTCCACATTATTGCAAGGA | 41 | 3744 |
| 876062 | 1022 | 1041 | 27997 | 28016 | GCTGCATTCTCTGGGTACTG | 28 | 3745 |
| 876086 | 1465 | 1484 | 35412 | 35431 | AATGTATATGCTTCTGCATT | 77 | 3746 |
| 876110 | 1494 | 1513 | 35441 | 35460 | TTTACAGCCACTTTCAGCCA | 63 | 3747 |
| 876134 | 2047 | 2066 | N/A | N/A | ATCCTTTAGTCTGTATTTCA | 83 | 3748 |
| 876158 | 2711 | 2730 | 65549 | 65568 | GACAGCACATCTTCAGAAAA | 64 | 3749 |
| 876182 | 3221 | 3240 | 76355 | 76374 | AAATGTGTCAAACTCTTCAG | 52 | 3750 |
| 876206 | 3747 | 3766 | 82092 | 82111 | TGCGGGACCTGGTAGGTACT | 57 | 3751 |
| 876230 | 3968 | 3987 | 83963 | 83982 | CCCATTTCATTGGGAAAGGA | 45 | 3752 |
| 876254 | 4520 | 4539 | 88621 | 88640 | AGTTCCTTGGTGATTTTACT | 45 | 3753 |
| 876278 | 4919 | 4938 | 93380 | 93399 | ATTTTACAAAGCCACTTGGG | 74 | 3754 |
| 876302 | 5195 | 5214 | 99201 | 99220 | GGCATTTCATATAGTCGGAT | 26 | 3755 |
| 876326 | 5644 | 5663 | 101282 | 101301 | GCCTTGGTTGATCTGGATTT | 32 | 3756 |
| 876350 | 6028 | 6047 | 113225 | 113244 | GTGCAATCCTGTGCTGTAGG | 42 | 3757 |
| 876374 | 6694 | 6713 | N/A | N/A | TACTATCAGCAACTTCCTCA | 100 | 3758 |
| 876398 | 7439 | 7458 | 143087 | 143106 | CGTATAAGTCGACGAGTTGA | 98 | 3759 |
| 876422 | 8442 | 8461 | 146611 | 146630 | TCAGGGTATCCACATTCAAA | 69 | 3760 |
| 876446 | N/A | N/A | 3734 | 3753 | TTACCTGCTGCACACTCGCG | 63 | 3761 |
| 876470 | N/A | N/A | 5242 | 5261 | TCCTTATTTTCCAGCATACT | 57 | 3762 |
| 876494 | N/A | N/A | 7823 | 7842 | TCTCTCTAAGAGAGAAGGTT | 64 | 3763 |
| 876518 | N/A | N/A | 10777 | 10796 | CTTCATGGTTTGAATTCAAA | 38 | 3764 |
| 876542 | N/A | N/A | 13175 | 13194 | AAATCATCAATTGTATACCT | 70 | 3765 |
| 876566 | N/A | N/A | 15815 | 15834 | CTCAATCAGTACTTCTAGCC | 79 | 3766 |
| 876590 | N/A | N/A | 17963 | 17982 | AGTTTATCTAGCTTGAGAAT | 67 | 3767 |
| 876614 | N/A | N/A | 20012 | 20031 | AAACCATGGCCTTTCTCTAT | 65 | 3768 |
| 876638 | N/A | N/A | 22763 | 22782 | CCAAAACATTATTATCCAGA | 58 | 3769 |
| 876662 | N/A | N/A | 26068 | 26087 | AGAAATTTGGGTTCTCAGCC | 64 | 3770 |
| 876686 | N/A | N/A | 28077 | 28096 | AAATGCCTCTGTAAGAATCC | 81 | 3771 |
| 876710 | N/A | N/A | 30722 | 30741 | AAGTGAGGAGAAGAGAATGG | 96 | 3772 |
| 876734 | N/A | N/A | 32675 | 32694 | TCTAAAGGTGCCCCAACAGA | 71 | 3773 |
| 876758 | N/A | N/A | 34015 | 34034 | ATCACATACACATTCTAAAA | 68 | 3774 |
| 876782 | N/A | N/A | 36424 | 36443 | ATAGATTAGTTAGACTGATG | 48 | 3775 |
| 876806 | N/A | N/A | 38547 | 38566 | TTCTGCTTGAAATGTCTTCC | 78 | 3776 |
| 876830 | N/A | N/A | 40757 | 40776 | TCTTTGTTCTATCACTTGAG | 72 | 3777 |
| 876854 | N/A | N/A | 42910 | 42929 | CCTTCTTCTCTTTTTCATAC | 42 | 3778 |
| 876878 | N/A | N/A | 46658 | 46677 | TAAAAATTTAGTCCTTCATC | 115 | 3779 |
| 876902 | N/A | N/A | 48098 | 48117 | AGGGTGCATAGTCTGTAGGT | 52 | 3780 |
| 876926 | N/A | N/A | 50310 | 50329 | CTGTTTGGCAGGCAAGGCCA | 114 | 3781 |
| 876950 | N/A | N/A | 52848 | 52867 | ATTCTAAATCCTGAATTCAA | 102 | 3782 |
| 876974 | N/A | N/A | 55881 | 55900 | AGGATGTTCATTTAACTATA | 53 | 3783 |
| 876998 | N/A | N/A | 57829 | 57848 | GAATATGGAAAGAGGAATAA | 94 | 3784 |
| 877022 | N/A | N/A | 61188 | 61207 | TCCATCAGTTACTGTGCTAA | 58 | 3785 |
| 877046 | N/A | N/A | 63238 | 63257 | GAAGAGAGAATTTAGAGCTA | 81 | 3786 |
| 877070 | N/A | N/A | 66210 | 66229 | AAAGCCCCTCACTCCATTTT | 60 | 3787 |
| 877094 | N/A | N/A | 67516 | 67535 | AAGTTAGTTGATTAAAAATT | 120 | 3788 |
| 877118 | N/A | N/A | 71000 | 71019 | ATAAATTTGGCTGGCAATAA | 76 | 3789 |
| 877142 | N/A | N/A | 72845 | 72864 | GTTAATGGTATTTATAATTA | 86 | 3790 |
| 877166 | N/A | N/A | 74324 | 74343 | ATTTTCAGAGAGCTATCCTA | 103 | 3791 |
| 877190 | N/A | N/A | 76592 | 76611 | CTTTCTTACCCTTCTAAAAT | 71 | 3792 |
| 877214 | N/A | N/A | 79053 | 79072 | CTGAGATGACACACTGACCA | 50 | 3793 |
| 877245 | N/A | N/A | 83601 | 83620 | CTCTTCAAGACATTGAAAGT | 81 | 3794 |
| 877269 | N/A | N/A | 86919 | 86938 | GAAATGAAGGGCTTTGGAAT | 76 | 3795 |
| 877293 | N/A | N/A | 89053 | 89072 | ATAAGAAGTTGAATCAGAAA | 99 | 3796 |
| 877317 | N/A | N/A | 91034 | 91053 | CTCTTAACCCAGAGAATTAG | 82 | 3797 |
| 877341 | N/A | N/A | 93061 | 93080 | ACAGAGCATATTTCACACAT | 42 | 3798 |
| 877365 | N/A | N/A | 95209 | 95228 | CCACAGAATCTTCAGGAATT | 45 | 3799 |
| 877389 | N/A | N/A | 96646 | 96665 | TTGGATAAATTATTCAACCT | 70 | 3800 |
| 877413 | N/A | N/A | 99821 | 99840 | TGATCATGCTAAACGCAAAA | 90 | 3801 |
| 877437 | N/A | N/A | 102050 | 102069 | GAATATTGAAACATGGTTAC | 48 | 3802 |
| 877461 | N/A | N/A | 104931 | 104950 | TCTTGGTATTCTCTCATTCT | 46 | 3803 |
| 877485 | N/A | N/A | 106787 | 106806 | TTACAACACACTATGTATCA | 86 | 3804 |
| 877509 | N/A | N/A | 109992 | 110011 | ATTAAACCAATATACCAAGG | 60 | 3805 |
| 877533 | N/A | N/A | 111782 | 111801 | GCAATTCAAAAAAAGTCCGA | 58 | 3806 |
| 877557 | N/A | N/A | 114063 | 114082 | TGAGAGAAATTGTTAGAAGC | 85 | 3807 |
| 877581 | N/A | N/A | 116850 | 116869 | TTTATAGAACACAGACTCTT | 88 | 3808 |
| 877605 | N/A | N/A | 119162 | 119181 | AGGGAGGTAAGATTCCACAG | 62 | 3809 |
| 877629 | N/A | N/A | 121067 | 121086 | CATATGTCAGAGGGTCCTAA | 63 | 3810 |
| 877653 | N/A | N/A | 123315 | 123334 | TTTGCTAAAATTATCTGTGC | 65 | 3811 |

TABLE 50-continued

Percent control of human LRRK2 RNA with 5-10-5 MOE gapmers with mixed internucleoside linkages

| Compound Number | SEQ ID NO: 1 Start Site | SEQ ID NO: 1 Stop Site | SEQ ID NO: 2 Start Site | SEQ ID NO: 2 Stop Site | Sequence (5' to 3') | LRRK2 % control | SEQ ID NO |
|---|---|---|---|---|---|---|---|
| 877677 | N/A | N/A | 126752 | 126771 | GATGGTGAAAATTATAGGAG | 50 | 3812 |
| 877701 | N/A | N/A | 129290 | 129309 | AAAAACCCTTGGGCCAACAA | 71 | 3813 |
| 877725 | N/A | N/A | 133380 | 133399 | CCCTGCTGTGATAGGCTTGA | 51 | 3814 |
| 877749 | N/A | N/A | 138071 | 138090 | TTGAAAGAGGTTTATATTAA | 95 | 3815 |
| 877773 | N/A | N/A | 140699 | 140718 | GGTGTCACTGTCATATTATA | 60 | 3816 |
| 877797 | N/A | N/A | 142490 | 142509 | ATAGTCTAATTCATGACAAA | 102 | 3817 |
| 877821 | N/A | N/A | 144612 | 144631 | CTATGTAGGCCCTAGGCTAG | 73 | 3818 |

Example 5: Effect of 5-10-5 MOE Gapmers with Phosphorothioate Internucleoside Linkages on Human LRRK2 RNA Expression In Vitro, Multiple Doses Modified oligonucleotides selected from Example 1 above were tested at various doses in SH-SY5Y cells. Cells were plated at a density of 20,000 cells per well and transfected using electroporation with 1.125 µM, 2.250 µM, 4.500 µM, 9.000 µM, and 18.000 µM concentrations of modified oligonucleotide, as specified in the tables below. After a treatment period of approximately 24 hours, total RNA was isolated from the cells and LRRK2 RNA levels were measured by quantitative real-time PCR. Human LRRK2 primer probe set RTS3133_MGB (described herein in Example 1) was used to measure RNA levels. LRRK2 RNA levels were adjusted according to total RNA content, as measured by RIBOGREENK® Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response–variable slope (4 parameters)" formula using Prism6 software.

TABLE 51

Dose-dependent reduction of human LRRK2 RNA expression in SH-SY5Y cells

| Compound Number | LRRK2 expression (% control) | | | | | $IC_{50}$ µM |
|---|---|---|---|---|---|---|
| | 1.125 µM | 2.250 µM | 4.500 µM | 9.000 µM | 18.000 µM | |
| 438387 | 81 | 43 | 30 | 18 | 14 | 2 |
| 438429 | 119 | 109 | 116 | 89 | 81 | 31 |
| 438432 | 110 | 78 | 64 | 42 | 15 | 7 |
| 438543 | 94 | 85 | 69 | 44 | 42 | 10 |
| 438565 | 92 | 80 | 80 | 66 | 53 | 22 |
| 438569 | 94 | 79 | 65 | 51 | 47 | 12 |
| 438586 | 98 | 85 | 52 | 38 | 27 | 6 |
| 438587 | 91 | 80 | 58 | 43 | 32 | 7 |
| 438595 | 86 | 66 | 41 | 35 | 25 | 4 |
| 438597 | 45 | 39 | 37 | 32 | 18 | n/a* |
| 438602 | 59 | 73 | 50 | 30 | 33 | 4 |
| 438622 | 109 | 115 | 100 | 92 | 85 | 40 |
| 438625 | 110 | 108 | 96 | 94 | 81 | 36 |
| 422428 | 75 | 57 | 35 | 27 | 20 | 3 |
| 422433 | 75 | 56 | 32 | 18 | 15 | 3 |

TABLE 51-continued

Dose-dependent reduction of human LRRK2 RNA expression in SH-SY5Y cells

| Compound Number | LRRK2 expression (% control) | | | | | $IC_{50}$ µM |
|---|---|---|---|---|---|---|
| | 1.125 µM | 2.250 µM | 4.500 µM | 9.000 µM | 18.000 µM | |
| 422450 | 81 | 97 | 87 | 71 | 66 | 51 |
| 422451 | 74 | 52 | 40 | 29 | 26 | 3 |
| 422461 | 89 | 65 | 44 | 30 | 25 | 4 |
| 438538 | 72 | 54 | 33 | 20 | 16 | 3 |
| 438544 | 65 | 39 | 28 | 18 | 12 | 2 |
| 438545 | 90 | 60 | 37 | 15 | 13 | 3 |
| 438548 | 89 | 65 | 38 | 20 | 16 | 4 |
| 438550 | 95 | 78 | 59 | 34 | 15 | 6 |
| 438560 | 56 | 41 | 30 | 22 | 23 | 1 |
| 438588 | 65 | 57 | 49 | 26 | 17 | 3 |
| 438652 | 109 | 94 | 74 | 54 | 53 | 15 |

*$IC_{50}$ value could not be calculated

Example 6: Effect of 5-10-5 MOE Gapmers with Mixed Internucleoside Linkages on Human LRRK2 RNA Expression In Vitro, Multiple Doses Modified oligonucleotides selected from Examples 2 and 3 above were tested at various doses in SH-SY5Y cells. Cells were plated at a density of 20,000 cells per well and transfected using electroporation with 0.333 µM, 1.000 µM, 3.000 µM, and 9.000 µM concentrations of modified oligonucleotide, as specified in the tables below. After a treatment period of approximately 24 hours, total RNA was isolated from the cells and LRRK2 RNA levels were measured by quantitative real-time PCR. Human LRRK2 primer probe set RTS3132 (described hereinabove in Example 2) was used to measure RNA levels. LRRK2 RNA levels were adjusted according to total RNA content, as measured by RIBOGREEN®. Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response–variable slope (4 parameters)" formula using Prism6 software.

TABLE 52

Dose-dependent reduction of human LRRK2 expression in SH-SY5Y cells

| Compound Number | LRRK2 expression (% control) | | | | $IC_{50}$ $\mu M$ |
|---|---|---|---|---|---|
| | 0.333 $\mu M$ | 1.000 $\mu M$ | 3.000 $\mu M$ | 9.000 $\mu M$ | |
| 693423 | 62 | 46 | 45 | 13 | 0.9 |
| 693428 | 58 | 45 | 34 | 13 | 0.7 |
| 693430 | 68 | 28 | 32 | 26 | 0.6 |
| 725607 | 66 | 42 | 30 | 21 | 0.8 |
| 725608 | 54 | 44 | 36 | 40 | 0.4 |
| 780148 | 80 | 67 | 51 | 19 | 2.2 |
| 780162 | 56 | 35 | 29 | 19 | 0.4 |
| 780164 | 43 | 24 | 21 | 24 | 0.07 |
| 780166 | 60 | 51 | 26 | 18 | 0.8 |
| 780189 | 60 | 37 | 22 | 31 | 0.5 |
| 780202 | 70 | 42 | 36 | 20 | 0.9 |
| 780205 | 68 | 44 | 32 | 25 | 0.9 |
| 780210 | 62 | 56 | 31 | 25 | 1.0 |
| 780219 | 75 | 52 | 24 | 31 | 1.2 |
| 780236 | 42 | 34 | 29 | 19 | 0.1 |
| 780241 | 67 | 47 | 18 | 5 | 0.8 |
| 780243 | 37 | 41 | 26 | 25 | n/a* |
| 780254 | 68 | 37 | 35 | 19 | 0.8 |
| 780284 | 66 | 44 | 26 | 19 | 0.8 |

*$IC_{50}$ value cannot be calculated

TABLE 53

Dose-dependent reduction of human LRRK2 expression in SH-SY5Y cells

| Compound Number | LRRK2 expression (% control) | | | | $IC_{50}$ $\mu M$ |
|---|---|---|---|---|---|
| | 0.333 $\mu M$ | 1.000 $\mu M$ | 3.000 $\mu M$ | 9.000 $\mu M$ | |
| 780254 | 61 | 45 | 23 | 17 | 0.7 |
| 780321 | 66 | 59 | 46 | 25 | 1.6 |
| 780347 | 55 | 47 | 43 | 47 | 0.8 |
| 780430 | 82 | 70 | 55 | 33 | 3.5 |
| 780442 | 80 | 81 | 43 | 31 | 3.0 |
| 780455 | 92 | 61 | 47 | 21 | 2.2 |
| 780461 | 74 | 90 | 72 | 40 | 7.3 |
| 780499 | 74 | 67 | 36 | 36 | 2.2 |
| 780535 | 86 | 71 | 75 | 63 | >60 |
| 780549 | 56 | 31 | 19 | 2 | 0.4 |
| 780551 | 93 | 65 | 26 | 35 | 1.9 |
| 780602 | 52 | 41 | 27 | 17 | 0.4 |
| 780624 | 71 | 52 | 37 | 27 | 1.3 |
| 780649 | 67 | 40 | 29 | 12 | 0.7 |
| 780670 | 85 | 71 | 55 | 31 | 3.4 |
| 780685 | 73 | 43 | 29 | 15 | 0.9 |
| 780700 | 96 | 61 | 36 | 24 | 2.0 |
| 780704 | 84 | 86 | 45 | 37 | 3.8 |
| 780706 | 94 | 72 | 66 | 42 | 6.1 |

Example 7: Effect of 5-10-5 MOE Gapmers with Mixed Internucleoside Linkages on Human LRRK2 RNA Expression In Vitro, Multiple Doses Modified oligonucleotides selected from Example 4 above were tested at various doses in SH-SY5Y cells. Cells were plated at a density of 20,000 cells per well and transfected using electroporation with 0.296, 0.888, 2.666, and 8.000 µM concentrations of modified oligonucleotide, as specified in the tables below. After a treatment period of approximately 24 hours, total RNA was isolated from the cells and LRRK2 RNA levels were measured by quantitative real-time PCR. Human LRRK2 primer probe set RTS3132 (described herein in Example 2) was used to measure RNA levels. LRRK2 RNA levels were adjusted according to total RNA content, as measured by RIBOGREEN® Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response–variable slope (4 parameters)" formula using Prism6 software.

TABLE 54

Dose-dependent reduction of human LRRK2 expression in SH-SY5Y cells

| Compound Number | LRRK2 expression (% control) | | | | $IC_{50}$ $\mu M$ |
|---|---|---|---|---|---|
| | 0.296 $\mu M$ | 0.888 $\mu M$ | 2.666 $\mu M$ | 8.000 $\mu M$ | |
| 780254 | 58 | 36 | 30 | 15 | 0.5 |
| 802655 | 103 | 90 | 87 | 20 | 5.0 |
| 802678 | 51 | 68 | 25 | 5 | 0.7 |
| 802685 | 110 | 82 | 43 | 13 | 2.3 |
| 802686 | 147 | 115 | 70 | 29 | 4.8 |
| 802688 | 87 | 67 | 40 | 15 | 1.7 |
| 802689 | 85 | 69 | 52 | 6 | 2.0 |
| 802700 | 163 | 84 | 29 | 29 | 2.0 |
| 802731 | 155 | 89 | 43 | 40 | 3.7 |
| 802746 | 120 | 78 | 65 | 18 | 3.5 |
| 802748 | 116 | 82 | 36 | 12 | 2.1 |
| 802758 | 119 | 71 | 31 | 5 | 1.7 |
| 802769 | 87 | 81 | 39 | 38 | 2.9 |
| 802778 | 97 | 53 | 56 | 30 | 2.6 |
| 802780 | 92 | 53 | 34 | 22 | 1.4 |
| 802784 | 84 | 82 | 42 | 26 | 2.5 |
| 802832 | 116 | 62 | 94 | 31 | 6.0 |
| 802888 | 58 | 54 | 26 | 10 | 0.7 |
| 802915 | 80 | 50 | 28 | 10 | 1.0 |

TABLE 55

Dose-dependent reduction of human LRRK2 expression in SH-SY5Y cells

| Compound Number | LRRK2 expression (% control) | | | | $IC_{50}$ $\mu M$ |
|---|---|---|---|---|---|
| | 0.296 $\mu M$ | 0.888 $\mu M$ | 2.666 $\mu M$ | 8.000 $\mu M$ | |
| 780254 | 76 | 56 | 26 | 12 | 1.0 |
| 802845 | 127 | 100 | 43 | 13 | 1.0 |
| 802911 | 77 | 44 | 27 | 11 | 0.8 |
| 802924 | 184 | 159 | 59 | 18 | n/a* |
| 802934 | 158 | 108 | 93 | 47 | 7.6 |
| 802949 | 113 | 69 | 33 | No signal | 1.7 |
| 802962 | 128 | 150 | 93 | 27 | 6.1 |
| 802966 | 171 | 130 | 17 | 31 | n/a* |
| 802974 | 120 | 71 | 36 | 13 | 1.9 |
| 803000 | 106 | 158 | 57 | 36 | 4.9 |
| 803021 | 80 | 112 | 75 | 70 | 22.1 |
| 803045 | 87 | 68 | 54 | 32 | 3.0 |
| 803046 | 70 | 69 | 28 | 14 | 1.2 |
| 803054 | 104 | 114 | 116 | 45 | n/a* |
| 803064 | 60 | 80 | 62 | 26 | 3.1 |
| 803065 | 101 | 89 | 27 | 55 | 4.0 |
| 803075 | 94 | 56 | 53 | 10 | 1.8 |
| 803112 | 90 | 37 | 27 | 11 | 0.9 |
| 803122 | 74 | 63 | 26 | 27 | 1.3 |

*$IC_{50}$ value cannot be calculated

TABLE 56

Dose-dependent reduction of human LRRK2 expression in SH-SY5Y cells

| Compound Number | LRRK2 expression (% control) | | | | $IC_{50}$ μM |
|---|---|---|---|---|---|
| | 0.296 μM | 0.888 μM | 2.666 μM | 8.000 μM | |
| 780254 | 57 | 43 | 30 | 10 | 0.5 |
| 803102 | 76 | 76 | 46 | 28 | 2.4 |
| 803123 | 103 | 110 | 60 | 30 | 4.2 |
| 803172 | 104 | 87 | 82 | 46 | 7.3 |
| 803177 | 138 | 98 | 72 | 41 | 5.9 |
| 803181 | 142 | 84 | 86 | 50 | 8.0 |
| 803272 | 105 | 94 | 68 | 47 | 6.6 |
| 803285 | 87 | 80 | 56 | 38 | 4.1 |
| 803359 | 102 | 81 | 105 | 69 | n/a* |
| 803386 | 81 | 65 | 28 | 24 | 1.4 |
| 803436 | 116 | 97 | 59 | 81 | n/a* |
| 803470 | 60 | 61 | 25 | 44 | 1.1 |
| 803503 | 71 | 50 | 61 | 50 | 8.4 |
| 803517 | 75 | 48 | 58 | 22 | 1.7 |
| 803519 | 80 | 59 | 43 | 52 | 3.9 |
| 803571 | 65 | 57 | 36 | 26 | 1.1 |
| 803595 | 66 | 62 | 34 | 25 | 1.2 |
| 803603 | 86 | 65 | 59 | 29 | 3.0 |
| 803604 | 50 | 32 | 52 | 22 | 0.2 |

*$IC_{50}$ value cannot be calculated

TABLE 57

Dose-dependent reduction of human LRRK2 expression in SH-SY5Y cells

| Compound Number | LRRK2 expression (% control) | | | | $IC_{50}$ μM |
|---|---|---|---|---|---|
| | 0.296 μM | 0.888 μM | 2.666 μM | 8.000 μM | |
| 780254 | 54 | 45 | 18 | 22 | 0.4 |
| 780620 | 120 | 87 | 77 | 37 | 5.7 |
| 780624 | 133 | 66 | 38 | 62 | 5.5 |
| 803541 | 110 | 86 | 40 | 16 | 2.3 |
| 803628 | 140 | 77 | 57 | 15 | 3.0 |
| 803629 | 78 | 31 | 40 | 15 | 0.8 |
| 803640 | 116 | 125 | 81 | 39 | 6.4 |
| 803645 | 123 | 117 | 59 | 33 | 4.5 |
| 803665 | 154 | 121 | 68 | 48 | 6.8 |
| 803680 | 87 | 71 | 39 | 27 | 2.1 |
| 803682 | 94 | 64 | 31 | 17 | 1.5 |
| 803686 | 79 | 69 | 54 | 21 | 2.3 |
| 803744 | 85 | 50 | 29 | 20 | 1.1 |
| 803745 | 91 | 75 | 55 | 24 | 2.9 |
| 803769 | 60 | 79 | 48 | 19 | 1.9 |
| 803770 | 43 | 38 | 25 | 5 | 0.2 |
| 803771 | 49 | 47 | 20 | 11 | 0.4 |
| 803773 | 73 | 54 | 28 | 28 | 1.1 |
| 803782 | 75 | 61 | 22 | 16 | 1.1 |

Example 8: Effect of 5-10-5 MOE Gapmers with Mixed Internucleoside Linkages on Human LRRK2 RNA Expression In Vitro, Multiple Doses Modified oligonucleotides selected from Example 4 above were tested at various doses in SH-SY5Y cells. Cells were plated at a density of 20,000 cells per well and transfected using electroporation with 0.444, 1.333, 4.000, and 12.000 M concentrations of modified oligonucleotide, as specified in the tables below. After a treatment period of approximately 24 hours, total RNA was isolated from the cells and LRRK2 RNA levels were measured by quantitative real-time PCR. Human LRRK2 primer probe set RTS3132 (described herein in Example 2) was used to measure RNA levels. LRRK2 RNA levels were adjusted according to total RNA content, as measured by RIBOGREEN®. Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response–variable slope (4 parameters)" formula using Prism6 software.

TABLE 58

Dose-dependent reduction of human LRRK2 expression in SH-SY5Y cells

| Compound Number | LRRK2 expression (% control) | | | | $IC_{50}$ μM |
|---|---|---|---|---|---|
| | 0.444 μM | 1.333 μM | 4.000 μM | 12.000 μM | |
| 780241 | 57 | 29 | 9 | 3 | 0.6 |
| 876032 | 80 | 56 | 25 | 12 | 1.6 |
| 876033 | 65 | 45 | 45 | 8 | 1.3 |
| 876035 | 65 | 59 | 35 | 17 | 1.6 |
| 876200 | 105 | 49 | 29 | 17 | 1.9 |
| 876201 | 83 | 84 | 45 | 22 | 3.8 |
| 876204 | 58 | 38 | 22 | 14 | 0.7 |
| 876224 | 74 | 48 | 41 | 15 | 1.6 |
| 876274 | 70 | 48 | 26 | 16 | 1.2 |
| 876298 | 60 | 47 | 42 | 28 | 1.2 |
| 876611 | 71 | 52 | 27 | 16 | 1.4 |
| 876683 | 79 | 58 | 23 | 27 | 1.8 |
| 876706 | 80 | 57 | 43 | 17 | 2.2 |
| 876850 | 89 | 64 | 37 | 16 | 2.4 |
| 876899 | 42 | 29 | 18 | 9 | 0.3 |
| 877113 | 53 | 44 | 34 | 10 | 0.7 |
| 877160 | 88 | 57 | 29 | 14 | 1.9 |
| 877239 | 115 | 93 | 59 | 31 | 6.1 |
| 877722 | 72 | 43 | 38 | 28 | 1.5 |

TABLE 59

Dose-dependent reduction of human LRRK2 expression in SH-SY5Y cells

| Compound Number | LRRK2 expression (% control) | | | | $IC_{50}$ μM |
|---|---|---|---|---|---|
| | 0.444 μM | 1.333 μM | 4.000 μM | 12.000 μM | |
| 780241 | 54 | 37 | 41 | 19 | n/a* |
| 803629 | 90 | 60 | 31 | 31 | 2.5 |
| 876062 | 62 | 38 | 16 | 7 | 0.8 |
| 876084 | 114 | 89 | 42 | 18 | 3.7 |
| 876109 | 84 | 58 | 59 | 40 | 5.6 |
| 876156 | 80 | 68 | 28 | 31 | 2.5 |
| 876180 | 79 | 53 | 41 | 15 | 1.9 |
| 876181 | 73 | 51 | 31 | 33 | 1.7 |
| 876276 | 93 | 51 | 19 | 11 | 1.5 |
| 876301 | 55 | 41 | 32 | 7 | 0.7 |
| 876302 | 47 | 25 | 21 | 7 | 0.3 |
| 876326 | 66 | 50 | 35 | 12 | 1.3 |
| 876900 | 63 | 42 | 21 | 13 | 0.9 |
| 876901 | 63 | 56 | 36 | 29 | 1.6 |
| 877068 | 66 | 42 | 17 | 5 | 0.9 |
| 877292 | 53 | 34 | 16 | 28 | 0.4 |
| 877364 | 71 | 53 | 28 | 31 | 1.6 |
| 877388 | 57 | 56 | 34 | 37 | 1.3 |
| 877748 | 71 | 58 | 40 | 24 | 2.0 |

*$IC_{50}$ value cannot be calculated

TABLE 60

Dose-dependent reduction of human LRRK2 expression in SH-SY5Y cells

| | LRRK2 expression (% control) | | | | |
|---|---|---|---|---|---|
| Compound Number | 0.444 µM | 1.333 µM | 4.000 µM | 12.000 µM | IC$_{50}$ µM |
| 780241 | 87 | 35 | 22 | 14 | 1.2 |
| 876038 | 68 | 39 | 40 | 32 | 1.3 |
| 876041 | 78 | 60 | 31 | 23 | 2.0 |
| 876042 | 52 | 34 | 25 | 12 | 0.5 |
| 876088 | 77 | 61 | 56 | 20 | 3.1 |
| 876089 | 80 | 76 | 48 | 15 | 3.2 |
| 876090 | 73 | 53 | 38 | 22 | 1.8 |
| 876185 | 55 | 52 | 32 | 15 | 0.9 |
| 876186 | 52 | 33 | 23 | 11 | 0.5 |
| 876282 | 53 | 35 | 25 | 11 | 0.5 |
| 876328 | 79 | 60 | 25 | 15 | 1.7 |
| 876401 | 83 | 60 | 52 | 42 | 5.1 |
| 876518 | 75 | 75 | 39 | 22 | 2.8 |
| 876713 | 61 | 59 | 50 | 19 | 1.9 |
| 876905 | 75 | 58 | 42 | 25 | 2.3 |
| 877098 | 82 | 54 | 34 | 24 | 2.0 |
| 877170 | 71 | 60 | 35 | 24 | 1.9 |
| 877392 | 68 | 48 | 31 | 23 | 1.3 |
| 877753 | 67 | 55 | 26 | 22 | 1.4 |

TABLE 61

Dose-dependent reduction of human LRRK2 expression in SH-SY5Y cells

| | LRRK2 expression (% control) | | | | |
|---|---|---|---|---|---|
| Compound Number | 0.444 µM | 1.333 µM | 4.000 µM | 12.000 µM | IC$_{50}$ µM |
| 780241 | 70 | 44 | 39 | 18 | 1.4 |
| 876019 | 67 | 45 | 28 | 11 | 1.1 |
| 876020 | 67 | 55 | 49 | 25 | 2.2 |
| 876066 | 60 | 62 | 36 | 19 | 1.5 |
| 876139 | 78 | 37 | 39 | 10 | 1.3 |
| 876140 | 80 | 47 | 36 | 14 | 1.6 |
| 876255 | 72 | 39 | 33 | 27 | 1.2 |
| 876260 | 70 | 46 | 22 | 29 | 1.2 |
| 876261 | 33 | 25 | 18 | 4 | n/a* |
| 876283 | 75 | 60 | 29 | 13 | 1.7 |
| 876284 | 48 | 35 | 35 | 18 | n/a* |
| 876303 | 48 | 21 | 32 | 2 | 0.3 |
| 876499 | 66 | 72 | 42 | 26 | 2.7 |
| 876735 | 67 | 43 | 28 | 7 | 1.0 |
| 876927 | 63 | 42 | 37 | 41 | 1.2 |
| 877119 | 61 | 31 | 35 | 4 | 0.7 |
| 877246 | 78 | 58 | 43 | 34 | 2.9 |
| 877370 | 69 | 58 | 46 | 40 | 3.3 |
| 877635 | 77 | 82 | 46 | 24 | 3.7 |

*IC$_{50}$ value cannot be calculated

TABLE 62

Dose-dependent reduction of human LRRK2 expression in SH-SY5Y cells

| | LRRK2 expression (% control) | | | | |
|---|---|---|---|---|---|
| Compound Number | 0.444 µM | 1.333 µM | 4.000 µM | 12.000 µM | IC$_{50}$ µM |
| 780241 | 62 | 42 | 16 | 23 | 0.8 |
| 780624 | 70 | 37 | 21 | 6 | 0.9 |
| 803640 | 80 | 34 | 53 | 43 | 3.0 |
| 876141 | 66 | 50 | 30 | 17 | 1.2 |
| 876143 | 70 | 55 | 38 | 29 | 1.9 |
| 876165 | 110 | 74 | 54 | 18 | 4.1 |
| 876166 | 64 | 53 | 34 | 27 | 1.4 |
| 876189 | 62 | 33 | 24 | 22 | 0.7 |
| 876190 | 44 | 27 | 34 | 10 | 0.2 |
| 876213 | 71 | 50 | 37 | 12 | 1.5 |
| 876237 | 52 | 41 | 20 | 15 | 0.6 |
| 876262 | 59 | 37 | 21 | 13 | 0.7 |
| 876263 | 61 | 36 | 36 | 23 | 0.8 |
| 876285 | 68 | 62 | 31 | 23 | 1.8 |
| 876286 | 69 | 67 | 33 | 21 | 2.0 |
| 876645 | 94 | 59 | 47 | 17 | 2.8 |
| 876766 | 67 | 37 | 26 | 13 | 0.9 |
| 876790 | 58 | 41 | 33 | 13 | 0.8 |
| 877222 | 68 | 48 | 32 | 20 | 1.3 |

TABLE 63

Dose-dependent reduction of human LRRK2 expression in SH-SY5Y cells

| | LRRK2 expression (% control) | | | | |
|---|---|---|---|---|---|
| Compound Number | 0.444 µM | 1.333 µM | 4.000 µM | 12.000 µM | IC$_{50}$ µM |
| 780241 | 71 | 54 | 41 | 27 | 2.0 |
| 876072 | 73 | 57 | 40 | 29 | 2.2 |
| 876073 | 72 | 52 | 24 | 25 | 1.4 |
| 876095 | 10 | 80 | 61 | 31 | 5.8 |
| 876097 | 55 | 44 | 42 | 24 | n/a* |
| 876168 | 64 | 45 | 21 | 9 | 0.9 |
| 876215 | 88 | 62 | 37 | 13 | 2.3 |
| 876288 | 75 | 62 | 28 | 6 | 1.7 |
| 876289 | 73 | 65 | 41 | 20 | 2.3 |
| 876335 | 77 | 75 | 43 | 25 | 3.2 |
| 876527 | 90 | 73 | 41 | 21 | 3.1 |
| 876769 | 78 | 67 | 41 | 31 | 1.5 |
| 877176 | 75 | 55 | 41 | 7 | 1.8 |
| 877303 | 61 | 45 | 23 | 19 | 0.8 |
| 877328 | 64 | 38 | 27 | 12 | 0.9 |
| 877375 | 82 | 68 | 47 | 28 | 3.5 |
| 877615 | 58 | 61 | 33 | 21 | 1.4 |
| 877616 | 75 | 50 | 25 | 19 | 1.4 |
| 877806 | 83 | 76 | 50 | 26 | 4.0 |

*IC$_{50}$ value can't be calculated

TABLE 64

Dose-dependent reduction of human LRRK2 expression in SH-SY5Y cells

| | LRRK2 expression (% control) | | | | |
|---|---|---|---|---|---|
| Compound Number | 0.444 µM | 1.333 µM | 4.000 µM | 12.000 µM | IC$_{50}$ µM |
| 780241 | 66 | 53 | 29 | 24 | 1.4 |
| 876050 | 83 | 58 | 52 | 17 | 2.8 |
| 876052 | 72 | 48 | 53 | 17 | 2.0 |
| 876053 | 75 | 47 | 36 | 20 | 1.6 |
| 876098 | 95 | 59 | 38 | 16 | 2.4 |
| 876149 | 71 | 52 | 28 | 20 | 1.4 |
| 876218 | 79 | 61 | 44 | 17 | 2.4 |
| 876220 | 68 | 43 | 39 | 18 | 1.3 |
| 876221 | 48 | 29 | 16 | 9 | 0.4 |
| 876293 | 72 | 54 | 21 | 17 | 1.3 |
| 876337 | 85 | 90 | 59 | 19 | 4.9 |
| 876362 | 86 | 73 | 54 | 26 | 4.2 |

TABLE 64-continued

Dose-dependent reduction of human LRRK2 expression in SH-SY5Y cells

| Compound Number | LRRK2 expression (% control) | | | | $IC_{50}$ $\mu M$ |
|---|---|---|---|---|---|
| | 0.444 $\mu M$ | 1.333 $\mu M$ | 4.000 $\mu M$ | 12.000 $\mu M$ | |
| 876385 | 81 | 62 | 36 | 20 | 2.3 |
| 876604 | 48 | 27 | 23 | 16 | 0.3 |
| 876725 | 66 | 50 | 39 | 35 | 1.7 |
| 876890 | 76 | 57 | 37 | 21 | 2.0 |
| 877156 | 80 | 58 | 44 | 28 | 2.7 |
| 877355 | 71 | 46 | 42 | 14 | 1.5 |
| 877356 | 49 | 41 | 24 | 29 | 0.3 |

TABLE 65

Dose-dependent reduction of human LRRK2 expression in SH-SY5Y cells

| Compound Number | LRRK2 expression (% control) | | | | $IC_{50}$ $\mu M$ |
|---|---|---|---|---|---|
| | 0.444 $\mu M$ | 1.333 $\mu M$ | 4.000 $\mu M$ | 12.000 $\mu M$ | |
| 780241 | 75 | 62 | 42 | 15 | 2.2 |
| 876027 | 87 | 76 | 74 | 54 | n/a* |
| 876030 | 75 | 60 | 44 | 18 | 2.3 |
| 876031 | 69 | 44 | 43 | 13 | 1.4 |
| 876123 | 68 | 48 | 28 | 27 | 1.3 |
| 876150 | 82 | 55 | 48 | 27 | 2.8 |
| 876195 | 77 | 51 | 31 | 45 | 2.4 |
| 876219 | 77 | 65 | 46 | 24 | 2.9 |
| 876222 | 102 | 68 | 54 | 21 | 3.9 |
| 876223 | 74 | 58 | 41 | 16 | 2.0 |
| 876294 | 44 | 25 | 16 | 10 | 0.3 |
| 876295 | 71 | 48 | 51 | 36 | 2.7 |
| 876315 | 75 | 58 | 46 | 41 | 3.7 |
| 877131 | 83 | 67 | 43 | 23 | 2.9 |
| 877159 | 68 | 59 | 41 | 24 | 2.0 |
| 877182 | 104 | 88 | 70 | 19 | 5.9 |
| 877334 | 93 | 87 | 51 | 22 | 4.4 |
| 877357 | 97 | 84 | 51 | 25 | 4.5 |
| 877718 | 73 | 57 | 51 | 32 | 3.0 |

*$IC_{50}$ value cannot be calculated

TABLE 66

Dose-dependent reduction of human LRRK2 expression in SH-SY5Y cells

| Compound Number | LRRK2 expression (% control) | | | | $IC_{50}$ $\mu M$ |
|---|---|---|---|---|---|
| | 0.444 $\mu M$ | 1.333 $\mu M$ | 4.000 $\mu M$ | 12.000 $\mu M$ | |
| 780241 | 63 | 36 | 24 | 23 | 0.8 |
| 803627 | 76 | 52 | 30 | 10 | 1.4 |
| 876008 | 59 | 56 | 33 | 31 | 1.3 |
| 876011 | 90 | 66 | 45 | 29 | 3.4 |
| 876034 | 102 | 67 | 39 | 28 | 3.2 |
| 876081 | 80 | 69 | 56 | 29 | 4.2 |
| 876106 | 64 | 43 | 31 | 23 | 1.0 |
| 876203 | 60 | 40 | 23 | 7 | 0.8 |
| 876225 | 77 | 54 | 41 | 32 | 2.4 |
| 876249 | 81 | 69 | 37 | 33 | 3.1 |
| 876321 | 74 | 63 | 43 | 21 | 2.4 |
| 876540 | 90 | 69 | 44 | 22 | 3.1 |
| 876704 | 83 | 73 | 49 | 47 | 6.8 |
| 876731 | 70 | 49 | 39 | 40 | 2.1 |
| 877088 | 77 | 61 | 38 | 31 | 2.6 |
| 877112 | 65 | 52 | 28 | 17 | 1.2 |

TABLE 66-continued

Dose-dependent reduction of human LRRK2 expression in SH-SY5Y cells

| Compound Number | LRRK2 expression (% control) | | | | $IC_{50}$ $\mu M$ |
|---|---|---|---|---|---|
| | 0.444 $\mu M$ | 1.333 $\mu M$ | 4.000 $\mu M$ | 12.000 $\mu M$ | |
| 877161 | 91 | 61 | 62 | 19 | 3.8 |
| 877289 | 73 | 55 | 34 | 20 | 1.7 |
| 877337 | 71 | 57 | 31 | 22 | 1.7 |

TABLE 67

Dose-dependent reduction of human LRRK2 expression in SH-SY5Y cells

| Compound Number | LRRK2 expression (% control) | | | | $IC_{50}$ $\mu M$ |
|---|---|---|---|---|---|
| | 0.444 $\mu M$ | 1.333 $\mu M$ | 4.000 $\mu M$ | 12.000 $\mu M$ | |
| 780241 | 50 | 107 | 20 | 6 | n/a* |
| 876015 | 89 | 63 | 46 | 35 | 3.8 |
| 876039 | 64 | 52 | 30 | 29 | 1.3 |
| 876043 | 56 | 41 | 20 | 6 | 0.7 |
| 876091 | 90 | 59 | 30 | 20 | 2.1 |
| 876092 | 72 | 49 | 33 | 21 | 1.5 |
| 876093 | 58 | 97 | 31 | 27 | 3.1 |
| 876187 | 75 | 55 | 47 | 21 | 2.2 |
| 876235 | 72 | 51 | 28 | 20 | 1.4 |
| 876380 | 86 | 57 | 41 | 27 | 2.6 |
| 876639 | 76 | 62 | 42 | 35 | 3.0 |
| 876668 | 75 | 54 | 31 | 22 | 1.7 |
| 876732 | 77 | 52 | 44 | 24 | 2.2 |
| 876741 | 75 | 113 | 46 | 51 | 9.0 |
| 876852 | 70 | 53 | 38 | 28 | 1.8 |
| 877171 | 57 | 39 | 32 | 26 | 0.7 |
| 877395 | 62 | 35 | 22 | 26 | 0.7 |
| 877396 | 77 | 42 | 32 | 7 | 1.2 |
| 877587 | 108 | 83 | 48 | 46 | 6.7 |

*$IC_{50}$ value cannot be calculated

TABLE 68

Dose-dependent reduction of human LRRK2 expression in SH-SY5Y cells

| Compound Number | LRRK2 expression (% control) | | | | $IC_{50}$ $\mu M$ |
|---|---|---|---|---|---|
| | 0.444 $\mu M$ | 1.333 $\mu M$ | 4.000 $\mu M$ | 12.000 $\mu M$ | |
| 780241 | 52 | 36 | 33 | 11 | 0.5 |
| 876119 | 80 | 67 | 42 | 22 | 2.8 |
| 876169 | 64 | 50 | 34 | 26 | 1.3 |
| 876239 | 71 | 44 | 29 | 23 | 1.2 |
| 876287 | 55 | 41 | 29 | 23 | 0.6 |
| 876334 | 64 | 51 | 44 | 37 | 2.0 |
| 876528 | 83 | 49 | 31 | 19 | 1.7 |
| 876649 | 78 | 60 | 37 | 32 | 2.5 |
| 876694 | 66 | 48 | 32 | 26 | 1.3 |
| 876912 | 68 | 48 | 25 | 30 | 1.2 |
| 876960 | 52 | 32 | 26 | 8 | 0.5 |
| 877102 | 67 | 48 | 30 | 32 | 1.3 |
| 877128 | 66 | 53 | 35 | 30 | 1.6 |
| 877198 | 73 | 52 | 35 | 17 | 1.6 |
| 877252 | 75 | 73 | 34 | 31 | 2.9 |
| 877326 | 50 | 40 | 33 | 12 | 0.5 |
| 877327 | 78 | 53 | 27 | 25 | 1.7 |
| 877349 | 47 | 41 | 33 | 24 | 0.3 |
| 877493 | 88 | 75 | 44 | 37 | 0.4 |

TABLE 69

Dose-dependent reduction of human LRRK2 expression in SH-SY5Y cells

| Compound Number | LRRK2 expression (% control) | | | | $IC_{50}$ μM |
|---|---|---|---|---|---|
| | 0.444 μM | 1.333 μM | 4.000 μM | 12.000 μM | |
| 780241 | 63 | 34 | 25 | 9 | 0.8 |
| 803643 | 49 | 59 | 54 | 32 | 1.7 |
| 876049 | 72 | 49 | 46 | 20 | 1.8 |
| 876074 | 54 | 32 | 28 | 7 | 0.5 |
| 876100 | 91 | 50 | 32 | 17 | 1.9 |
| 876124 | 61 | 37 | 17 | 23 | 0.7 |
| 876146 | 52 | 36 | 30 | 26 | 0.4 |
| 876170 | 78 | 48 | 41 | 25 | 1.9 |
| 876173 | 65 | 51 | 23 | 30 | 1.2 |
| 876244 | 71 | 52 | 29 | 31 | 1.6 |
| 876482 | 84 | 83 | 48 | 23 | 4.0 |
| 876553 | 79 | 54 | 32 | 23 | 1.8 |
| 876748 | 75 | 45 | 25 | 14 | 1.2 |
| 876821 | 83 | 64 | 40 | 26 | 2.8 |
| 877204 | 101 | 76 | 45 | 29 | 4.1 |
| 877305 | 63 | 41 | 28 | 17 | 0.9 |
| 877307 | 72 | 50 | 31 | 25 | 1.5 |
| 877496 | 71 | 59 | 34 | 24 | 1.9 |
| 877617 | 62 | 71 | 31 | 20 | 1.8 |

TABLE 70

Dose-dependent reduction of human LRRK2 expression in SH-SY5Y cells

| Compound Number | LRRK2 expression (% control) | | | | $IC_{50}$ μM |
|---|---|---|---|---|---|
| | 0.444 μM | 1.333 μM | 4.000 μM | 12.000 μM | |
| 780241 | 62 | 39 | 34 | 7 | 0.9 |
| 876054 | 72 | 74 | 42 | 27 | 3.0 |
| 876151 | 66 | 62 | 53 | 34 | 3.5 |
| 876175 | 95 | 48 | 36 | 29 | 2.3 |
| 876197 | 75 | 64 | 37 | 29 | 2.5 |
| 876318 | 68 | 58 | 39 | 16 | 1.7 |
| 876339 | 91 | 77 | 43 | 25 | 3.6 |
| 876414 | 77 | 52 | 48 | 25 | 2.4 |
| 876507 | 103 | 80 | 66 | 46 | 9.2 |
| 876607 | 79 | 57 | 43 | 25 | 2.4 |
| 876631 | 68 | 43 | 25 | 25 | 1.1 |
| 876727 | 93 | 79 | 59 | 32 | 5.6 |
| 876747 | 75 | 54 | 35 | 19 | 1.8 |
| 876867 | 71 | 54 | 25 | 13 | 1.3 |
| 877524 | 106 | 106 | 71 | 42 | 9.0 |
| 877573 | 75 | 59 | 36 | 28 | 2.1 |
| 877597 | 88 | 79 | 45 | 33 | 4.3 |
| 877644 | 94 | 67 | 41 | 45 | 4.8 |
| 877692 | 78 | 67 | 53 | 25 | 3.5 |

Example 9: Design of Gapmers with Mixed Internucleoside Linkages Complementary to Human LRRK2 RNA Modified oligonucleotides complementary to a human LRRK2 nucleic acid were designed. The modified oligonucleotides in Table 71 are gapmers. The gapmers have a central gap segment that comprises 2′-deoxynucleosides and is flanked by wing segments on both the 5′ end on the 3′ end comprising and cEt nucleosides and/or 2′-MOE nucleosides. All cytosine residues throughout each gapmer are 5′-methyl cytosines. The internucleoside linkages are mixed phosphodiester internucleoside linkages and phosphorothioate internucleoside linkages. The sequence and chemical notation column specifies the sequence, including 5′-methyl cytosines, sugar chemistry, and the internucleoside linkage chemistry, wherein subscript 'd' represents a 2′-deoxyribose sugar; subscript 'e' represents a 2′-MOE modified sugar; subscript 'k' represents a cEt modified sugar; subscript 'o' represents a phosphodiester internucleoside linkage; subscript 's' represents a phosphorothioate internucleoside linkage; and a 'm' superscript before the cytosine residue indicates a 5-methyl cytosine. "Start Site" indicates the 5′-most nucleoside to which the gapmer is complementary in the human nucleic acid sequence. "Stop Site" indicates the 3′-most nucleoside to which the gapmer is complementary in the human nucleic acid sequence.

Each modified oligonucleotide listed in the table below is complementary to human LRRK2 nucleic acid sequence SEQ ID NO: 1 or SEQ ID NO: 2, as indicated. 'N/A' indicates that the modified oligonucleotide is not complementary to that particular nucleic acid with 100% complementarity.

TABLE 71

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5′ to 3′) | SEQ ID NO Unmodified | SEQ ID NO Modified |
|---|---|---|---|---|---|---|---|
| 872246 | 3714 | 3733 | 82059 | 82078 | $G_{es}{}^mC_{eo}T_{eo}{}^mC_{es}A_{es}T_{ds}A_{ds}T_{ds}{}^mC_{ds}T_{ds}A_d A_{ds}A_{ds}G_{ds}A_{ds}{}^mC_{eo}{}^mC_{eo}G_{es}{}^mC_{es}A_e$ | 222 | 3849 |
| 872247 | N/A | N/A | 52154 | 52173 | $G_{es}{}^mC_{eo}{}^mC_{eo}A_{es}A_{es}A_{ds}{}^mC_{ds}T_{ds}T_{ds}A_d {}_sA_{ds}A_{ds}G_{ds}A_{ds}T_{eo}G_{eo}{}^mC_{es}A_{es}G_e$ | 599 | 3856 |
| 872248 | 3494 | 3513 | 77243 | 77262 | $A_{es}G_{eo}T_{eo}T_{es}{}^mC_{es}{}^mC_{ds}T_{ds}T_{ds}{}^mC_{ds}A_{ds}G_d {}_sT_{ds}{}^mC_{ds}T_{ds}{}^mC_{ds}A_{eo}A_{eo}G_{es}G_{es}G_e$ | 217 | 3857 |
| 872249 | 7776 | 7795 | 145945 | 145964 | $G_{es}A_{eo}G_{eo}T_{es}A_{es}{}^mC_{ds}{}^mC_{ds}{}^mC_{ds}T_{ds}T_{ds}T_d {}_s{}^mC_{ds}{}^mC_{ds}A_{ds}T_{ds}G_{eo}T_{eo}G_{es}A_{es}A_e$ | 398 | 3854 |
| 872250 | 988 | 1007 | 27963 | 27982 | ${}^mC_{es}{}^mC_{eo}A_{eo}{}^mC_{es}A_{es}A_{ds}A_{ds}{}^mC_{ds}T_{ds}{}^mC_d A_{ds}T_{ds}G_{ds}G_{ds}A_{ds}{}^mC_{eo}T_{eo}T_{es}{}^mC_{es}G_e$ | 293 | 3859 |
| 872251 | 3714 | 3733 | 82059 | 82078 | $G_{es}{}^mC_{eo}T_{es}{}^mC_{es}A_{es}T_{ds}A_{ds}T_{ds}{}^mC_{ds}T_{ds}A_d A_{ds}A_{ds}G_{ds}A_{ds}{}^mC_{eo}{}^mC_{eo}G_{es}{}^mC_{es}A_e$ | 222 | 3860 |

TABLE 71-continued

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO Unmodified | SEQ ID NO Modified |
|---|---|---|---|---|---|---|---|
| 872252 | N/A | N/A | 52154 | 52173 | G$_{es}$$^m$C$_{eo}$$^m$C$_{es}$A$_{es}$A$_{es}$A$_{ds}$$^m$C$_{ds}$T$_{ds}$T$_{ds}$T$_{ds}$A$_{ds}$A$_{ds}$A$_{ds}$G$_{ds}$A$_{ds}$T$_{eo}$G$_{eo}$$^m$C$_{es}$A$_{es}$G$_{e}$ | 599 | 3861 |
| 872253 | 3494 | 3513 | 77243 | 77262 | A$_{es}$G$_{eo}$T$_{es}$T$_{es}$$^m$C$_{es}$$^m$C$_{ds}$T$_{ds}$T$_{ds}$$^m$C$_{ds}$A$_{ds}$G$_{ds}$T$_{ds}$$^m$C$_{ds}$T$_{ds}$$^m$C$_{ds}$A$_{eo}$A$_{eo}$G$_{es}$G$_{es}$G$_{e}$ | 217 | 3862 |
| 872254 | 7776 | 7795 | 145945 | 145964 | G$_{es}$A$_{eo}$G$_{es}$T$_{es}$A$_{es}$$^m$C$_{ds}$$^m$C$_{ds}$$^m$C$_{ds}$T$_{ds}$T$_{ds}$T$_{d}$$_s$$^m$C$_{ds}$$^m$C$_{ds}$A$_{ds}$T$_{ds}$G$_{eo}$T$_{eo}$G$_{es}$A$_{es}$A$_{e}$ | 398 | 3863 |
| 872255 | 988 | 1007 | 27963 | 27982 | $^m$C$_{es}$$^m$C$_{eo}$A$_{es}$$^m$C$_{es}$A$_{es}$A$_{ds}$A$_{ds}$$^m$C$_{ds}$T$_{ds}$$^m$C$_{ds}$A$_{ds}$T$_{ds}$G$_{ds}$G$_{ds}$A$_{ds}$$^m$C$_{eo}$T$_{eo}$T$_{es}$$^m$C$_{es}$G$_{e}$ | 293 | 3864 |
| 872256 | 3714 | 3733 | 82059 | 82078 | G$_{es}$$^m$C$_{eo}$T$_{es}$$^m$C$_{es}$A$_{es}$T$_{ds}$A$_{ds}$T$_{ds}$$^m$C$_{ds}$T$_{ds}$A$_{ds}$A$_{ds}$A$_{ds}$G$_{ds}$A$_{ds}$$^m$C$_{es}$$^m$C$_{eo}$G$_{es}$$^m$C$_{es}$A$_{e}$ | 222 | 3865 |
| 872257 | N/A | N/A | 52154 | 52173 | G$_{es}$$^m$C$_{eo}$$^m$C$_{es}$A$_{es}$A$_{es}$A$_{ds}$$^m$C$_{ds}$T$_{ds}$T$_{ds}$T$_{ds}$A$_{ds}$A$_{ds}$A$_{ds}$G$_{ds}$A$_{ds}$T$_{es}$G$_{eo}$$^m$C$_{es}$A$_{es}$G$_{e}$ | 599 | 3866 |
| 872258 | 3494 | 3513 | 77243 | 77262 | A$_{es}$G$_{eo}$T$_{es}$T$_{es}$$^m$C$_{es}$$^m$C$_{ds}$T$_{ds}$T$_{ds}$$^m$C$_{ds}$A$_{ds}$G$_{d}$$_s$T$_{ds}$$^m$C$_{ds}$T$_{ds}$$^m$C$_{ds}$A$_{eo}$A$_{eo}$G$_{es}$G$_{es}$G$_{e}$ | 217 | 3867 |
| 872259 | 7776 | 7795 | 145945 | 145964 | G$_{es}$A$_{eo}$G$_{es}$T$_{es}$A$_{es}$$^m$C$_{ds}$$^m$C$_{ds}$C$_{ds}$T$_{ds}$T$_{ds}$T$_{d}$$_s$$^m$C$_{ds}$$^m$C$_{ds}$A$_{ds}$T$_{ds}$G$_{es}$T$_{eo}$G$_{es}$A$_{es}$A$_{e}$ | 398 | 3868 |
| 872260 | 988 | 1007 | 27963 | 27982 | $^m$C$_{es}$$^m$C$_{eo}$A$_{es}$$^m$C$_{es}$A$_{es}$A$_{ds}$A$_{ds}$$^m$C$_{ds}$T$_{ds}$$^m$C$_{ds}$A$_{ds}$T$_{ds}$Gi$_{ds}$G$_{ds}$A$_{ds}$$^m$C$_{es}$T$_{eo}$T$_{es}$$^m$C$_{es}$G$_{e}$ | 293 | 3869 |
| 872261 | 3714 | 3733 | 82059 | 82078 | G$_{es}$$^m$C$_{es}$T$_{es}$$^m$C$_{es}$A$_{es}$T$_{ds}$A$_{ds}$T$_{ds}$$^m$C$_{ds}$T$_{ds}$A$_{ds}$A$_{ds}$A$_{ds}$G$_{ds}$A$_{ds}$$^m$C$_{es}$$^m$C$_{eo}$G$_{es}$$^m$C$_{es}$A$_{e}$ | 222 | 3870 |
| 872262 | N/A | N/A | 52154 | 52173 | G$_{es}$$^m$C$_{es}$$^m$C$_{es}$A$_{es}$A$_{es}$A$_{ds}$$^m$C$_{ds}$T$_{ds}$T$_{ds}$T$_{ds}$A$_{d}$$_s$A$_{ds}$A$_{ds}$G$_{ds}$A$_{ds}$T$_{es}$G$_{eo}$$^m$C$_{es}$A$_{es}$G$_{e}$ | 599 | 3871 |
| 872263 | 3494 | 3513 | 77243 | 77262 | A$_{es}$G$_{es}$T$_{es}$T$_{es}$$^m$C$_{es}$$^m$C$_{ds}$T$_{ds}$T$_{ds}$$^m$C$_{ds}$A$_{ds}$G$_{ds}$T$_{ds}$$^m$C$_{ds}$T$_{ds}$$^m$C$_{ds}$A$_{eo}$G$_{es}$G$_{es}$G$_{e}$ | 217 | 3872 |
| 872264 | 7776 | 7795 | 145945 | 145964 | G$_{es}$A$_{es}$G$_{es}$T$_{es}$A$_{es}$$^m$C$_{ds}$$^m$C$_{ds}$$^m$C$_{ds}$T$_{ds}$T$_{ds}$T$_{ds}$$^m$C$_{ds}$$^m$C$_{ds}$A$_{ds}$T$_{ds}$G$_{es}$T$_{eo}$G$_{es}$A$_{es}$A$_{e}$ | 398 | 3873 |
| 872265 | 988 | 1007 | 27963 | 27982 | $^m$C$_{es}$$^m$C$_{es}$A$_{es}$$^m$C$_{es}$A$_{es}$A$_{ds}$A$_{ds}$$^m$C$_{ds}$T$_{ds}$$^m$C$_{ds}$A$_{ds}$T$_{ds}$Gi$_{ds}$G$_{ds}$A$_{ds}$$^m$C$_{es}$T$_{eo}$T$_{es}$$^m$C$_{es}$G$_{e}$ | 293 | 3874 |
| 872266 | 3712 | 3731 | 82057 | 82076 | T$_{es}$$^m$C$_{eo}$A$_{es}$T$_{es}$A$_{es}$T$_{ds}$$^m$C$_{ds}$T$_{ds}$A$_{ds}$A$_{ds}$A$_{ds}$G$_{ds}$A$_{ds}$$^m$C$_{ds}$$^m$C$_{ds}$G$_{es}$$^m$C$_{eo}$A$_{es}$A$_{es}$G$_{e}$ | 1129 | 3875 |
| 872267 | 3713 | 3732 | 82058 | 82077 | $^m$C$_{es}$T$_{eo}$$^m$C$_{es}$A$_{es}$T$_{es}$A$_{ds}$T$_{ds}$$^m$C$_{ds}$T$_{ds}$A$_{ds}$A$_{d}$$_s$A$_{ds}$G$_{ds}$A$_{ds}$$^m$C$_{ds}$$^m$C$_{es}$G$_{eo}$$^m$C$_{es}$A$_{es}$A$_{e}$ | 1130 | 3876 |
| 872268 | 3715 | 3734 | 82060 | 82079 | T$_{es}$G$_{eo}$$^m$C$_{es}$T$_{es}$$^m$C$_{es}$A$_{ds}$T$_{ds}$A$_{ds}$T$_{ds}$$^m$C$_{ds}$T$_{ds}$A$_{ds}$A$_{ds}$A$_{ds}$G$_{ds}$A$_{es}$$^m$C$_{eo}$$^m$C$_{es}$G$_{es}$$^m$C$_{e}$ | 1131 | 3877 |
| 872269 | 3716 | 3735 | 82061 | 82080 | $^m$C$_{es}$T$_{eo}$G$_{es}$$^m$C$_{es}$T$_{es}$$^m$C$_{ds}$A$_{ds}$T$_{ds}$A$_{ds}$T$_{ds}$$^m$C$_{ds}$T$_{ds}$A$_{ds}$A$_{ds}$A$_{ds}$G$_{es}$A$_{eo}$$^m$C$_{es}$$^m$C$_{es}$G$_{e}$ | 1132 | 3878 |
| 872270 | 3717 | 3736 | 82062 | 82081 | G$_{es}$$^m$C$_{eo}$T$_{es}$G$_{es}$$^m$C$_{es}$T$_{ds}$$^m$C$_{ds}$A$_{ds}$T$_{ds}$A$_{ds}$T$_{d}$$_s$$^m$C$_{ds}$T$_{ds}$A$_{ds}$A$_{ds}$A$_{ds}$G$_{eo}$A$_{es}$$^m$C$_{es}$$^m$C$_{e}$ | 1133 | 3879 |
| 872271 | N/A | N/A | 52151 | 52170 | A$_{es}$A$_{eo}$A$_{es}$$^m$C$_{es}$T$_{es}$T$_{ds}$T$_{ds}$A$_{ds}$A$_{ds}$A$_{ds}$G$_{ds}$A$_{ds}$T$_{ds}$G$_{ds}$$^m$C$_{ds}$A$_{es}$G$_{eo}$A$_{es}$A$_{es}$A$_{e}$ | 1677 | 3880 |
| 872272 | N/A | N/A | 52152 | 52171 | $^m$C$_{es}$A$_{eo}$A$_{es}$A$_{es}$$^m$C$_{es}$T$_{ds}$T$_{ds}$T$_{ds}$A$_{ds}$A$_{ds}$A$_{ds}$G$_{ds}$A$_{ds}$T$_{ds}$G$_{ds}$$^m$C$_{ds}$A$_{es}$G$_{eo}$A$_{es}$A$_{es}$A$_{e}$ | 1678 | 3881 |
| 872273 | N/A | N/A | 52153 | 52172 | $^m$C$_{es}$$^m$C$_{eo}$A$_{es}$A$_{es}$A$_{es}$$^m$C$_{ds}$T$_{ds}$T$_{ds}$T$_{ds}$A$_{ds}$A$_{d}$$_s$A$_{ds}$G$_{ds}$A$_{ds}$T$_{ds}$G$_{es}$$^m$C$_{eo}$A$_{es}$G$_{es}$A$_{e}$ | 1679 | 3882 |
| 872274 | N/A | N/A | 52155 | 52174 | T$_{es}$G$_{eo}$$^m$C$_{es}$$^m$C$_{es}$A$_{es}$A$_{ds}$A$_{ds}$A$_{ds}$$^m$C$_{ds}$T$_{ds}$T$_{ds}$T$_{d}$$_s$A$_{ds}$A$_{ds}$A$_{ds}$G$_{ds}$A$_{es}$T$_{eo}$G$_{es}$$^m$C$_{es}$A$_{e}$ | 1680 | 3883 |
| 872275 | N/A | N/A | 52156 | 52175 | T$_{es}$T$_{eo}$G$_{es}$$^m$C$_{es}$$^m$C$_{es}$A$_{ds}$A$_{ds}$A$_{ds}$$^m$C$_{ds}$T$_{ds}$T$_{ds}$T$_{d}$$_s$T$_{ds}$A$_{ds}$A$_{ds}$A$_{ds}$G$_{es}$A$_{eo}$T$_{es}$G$_{es}$$^m$C$_{e}$ | 1681 | 3884 |
| 872276 | N/A | N/A | 52157 | 52176 | T$_{es}$T$_{eo}$T$_{es}$G$_{es}$$^m$C$_{es}$$^m$C$_{ds}$A$_{ds}$A$_{ds}$A$_{ds}$$^m$C$_{ds}$T$_{d}$$_s$T$_{ds}$T$_{ds}$A$_{ds}$A$_{ds}$A$_{es}$G$_{eo}$A$_{es}$T$_{es}$G$_{e}$ | 1682 | 3885 |
| 872277 | 3495 | 3514 | 77244 | 77263 | $^m$C$_{es}$A$_{eo}$G$_{es}$T$_{es}$T$_{es}$$^m$C$_{ds}$$^m$C$_{ds}$T$_{ds}$T$_{ds}$$^m$C$_{ds}$A$_{d}$$_s$G$_{ds}$T$_{ds}$$^m$C$_{ds}$T$_{ds}$$^m$C$_{es}$A$_{eo}$A$_{es}$G$_{es}$G$_{e}$ | 1107 | 3886 |
| 872278 | 3496 | 3515 | 77245 | 77264 | T$_{es}$$^m$C$_{eo}$A$_{es}$G$_{es}$T$_{es}$T$_{ds}$$^m$C$_{ds}$$^m$C$_{ds}$T$_{ds}$T$_{ds}$$^m$C$_{ds}$A$_{ds}$G$_{ds}$T$_{ds}$$^m$C$_{ds}$T$_{es}$$^m$C$_{eo}$A$_{es}$A$_{es}$G$_{e}$ | 1108 | 3887 |
| 872279 | 3497 | 3516 | 77246 | 77265 | T$_{es}$T$_{eo}$$^m$C$_{es}$A$_{es}$G$_{es}$T$_{ds}$T$_{ds}$$^m$C$_{ds}$$^m$C$_{ds}$T$_{ds}$T$_{ds}$$^m$C$_{ds}$A$_{ds}$G$_{ds}$T$_{ds}$$^m$C$_{es}$T$_{eo}$$^m$C$_{es}$A$_{es}$A$_{e}$ | 1109 | 3888 |
| 872280 | 7773 | 7792 | 145942 | 145961 | T$_{es}$A$_{eo}$$^m$C$_{es}$$^m$C$_{es}$$^m$C$_{es}$T$_{ds}$T$_{ds}$T$_{ds}$$^m$C$_{ds}$$^m$C$_{ds}$A$_{ds}$T$_{ds}$G$_{ds}$T$_{ds}$G$_{ds}$A$_{eo}$$^m$C$_{es}$A$_{es}$T$_{e}$ | 1432 | 3889 |
| 872281 | 7774 | 7793 | 145943 | 145962 | G$_{es}$T$_{eo}$A$_{es}$$^m$C$_{es}$$^m$C$_{es}$C$_{ds}$T$_{ds}$T$_{ds}$T$_{ds}$$^m$C$_{ds}$$^m$C$_{ds}$A$_{ds}$T$_{ds}$G$_{ds}$T$_{ds}$G$_{es}$A$_{eo}$A$_{es}$$^m$C$_{es}$A$_{e}$ | 1433 | 3890 |
| 872282 | 7775 | 7794 | 145944 | 145963 | A$_{es}$G$_{eo}$T$_{es}$A$_{es}$$^m$C$_{es}$$^m$C$_{ds}$$^m$C$_{ds}$T$_{ds}$T$_{ds}$T$_{ds}$$^m$C$_{ds}$$^m$C$_{ds}$A$_{ds}$T$_{ds}$G$_{ds}$T$_{es}$G$_{eo}$A$_{es}$A$_{es}$$^m$C$_{e}$ | 1434 | 3891 |
| 872283 | 7777 | 7796 | 145946 | 145965 | T$_{es}$G$_{eo}$A$_{es}$G$_{es}$T$_{es}$A$_{ds}$$^m$C$_{ds}$$^m$C$_{ds}$$^m$C$_{ds}$T$_{ds}$T$_{ds}$T$_{d}$$_s$T$_{ds}$$^m$C$_{ds}$$^m$C$_{ds}$A$_{ds}$T$_{es}$G$_{eo}$T$_{es}$G$_{es}$A$_{e}$ | 1435 | 3892 |
| 872284 | 7778 | 7797 | 145947 | 145966 | G$_{es}$T$_{eo}$G$_{es}$A$_{es}$G$_{es}$T$_{ds}$A$_{ds}$$^m$C$_{ds}$$^m$C$_{ds}$$^m$C$_{ds}$T$_{d}$$_s$T$_{ds}$T$_{ds}$$^m$C$_{ds}$$^m$C$_{ds}$A$_{es}$T$_{eo}$G$_{es}$T$_{es}$G$_{e}$ | 1436 | 3893 |
| 872285 | 7779 | 7798 | 145948 | 145967 | T$_{es}$G$_{eo}$T$_{es}$G$_{es}$A$_{es}$G$_{ds}$T$_{ds}$A$_{ds}$$^m$C$_{ds}$$^m$C$_{ds}$$^m$C$_{d}$$_s$T$_{ds}$T$_{ds}$T$_{ds}$$^m$C$_{ds}$$^m$C$_{es}$A$_{eo}$T$_{es}$G$_{es}$T$_{e}$ | 1437 | 3894 |
| 874144 | N/A | N/A | 82056 | 82075 | $^m$C$_{es}$A$_{eo}$T$_{eo}$A$_{eo}$T$_{es}$$^m$C$_{ds}$T$_{ds}$A$_{ds}$A$_{ds}$A$_{ds}$G$_{ds}$A$_{ds}$$^m$C$_{ds}$$^m$C$_{ds}$G$_{ds}$$^m$C$_{eo}$A$_{eo}$A$_{es}$G$_{es}$$^m$C$_{e}$ | 3820 | 3895 |
| 874145 | 3493 | 3512 | 77242 | 77261 | G$_{es}$T$_{eo}$T$_{eo}$$^m$C$_{eo}$$^m$C$_{es}$T$_{ds}$T$_{ds}$$^m$C$_{ds}$A$_{ds}$G$_{ds}$T$_{d}$$_s$$^m$C$_{ds}$T$_{ds}$$^m$C$_{ds}$A$_{ds}$A$_{eo}$G$_{eo}$G$_{es}$G$_{es}$G$_{e}$ | 3821 | 3896 |

TABLE 71-continued

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO Unmodified | SEQ ID NO Modified |
|---|---|---|---|---|---|---|---|
| 874146 | 3492 | 3511 | 77241 | 77260 | $T_{es}T_{eo}{}^mC_{eo}{}^mC_{es}T_{es}T_{ds}{}^mC_{ds}A_{ds}G_{ds}T_{ds}{}^mC_{ds}T_{ds}{}^mC_{ds}A_{ds}A_{ds}G_{eo}G_{eo}G_{es}G_{es}G_e$ | 3822 | 3897 |
| 874147 | 3491 | 3510 | 77240 | 77259 | $T_{es}{}^mC_{eo}{}^mC_{eo}T_{eo}T_{es}{}^mC_{ds}A_{ds}G_{ds}T_{ds}{}^mC_{ds}T_{ds}{}^mC_{ds}A_{ds}A_{ds}G_{ds}G_{eo}G_{eo}G_{es}G_{es}A_e$ | 3823 | 3898 |
| 874148 | 4117 | 4136 | 86612 | 86631 | $T_{es}{}^mC_{eo}A_{eo}T_{eo}A_{es}A_{ds}T_{ds}T_{ds}T_{ds}{}^mC_{ds}A_{ds}T_{ds}T_{ds}{}^mC_{ds}G_{eo}G_{eo}T_{es}T_{es}A_e$ | 3824 | 3899 |
| 874149 | N/A | N/A | 82056 | 82075 | ${}^mC_{es}A_{eo}T_{es}A_{es}T_{es}{}^mC_{ds}T_{ds}A_{ds}A_{ds}A_{ds}G_{ds}A_{ds}{}^mC_{ds}{}^mC_{ds}G_{ds}{}^mIC_{es}A_{eo}A_{es}G_{es}{}^mC_e$ | 3820 | 3900 |
| 874150 | 3493 | 3512 | 77242 | 77261 | $G_{es}T_{eo}T_{es}{}^mC_{es}{}^mC_{es}T_{ds}T_{ds}{}^mC_{ds}A_{ds}G_{ds}T_{ds}{}^mC_{ds}T_{ds}{}^mC_{ds}A_{ds}A_{es}G_{eo}G_{es}G_{es}G_e$ | 3821 | 3901 |
| 874151 | 3492 | 3511 | 77241 | 77260 | $T_{es}T_{eo}{}^mC_{es}{}^mC_{es}T_{es}T_{ds}{}^mC_{ds}A_{ds}G_{ds}T_{ds}{}^mC_{ds}T_{ds}{}^mC_{ds}A_{ds}A_{ds}G_{es}G_{eo}G_{es}G_{es}G_e$ | 3822 | 3902 |
| 890206 | N/A | N/A | 61977 | 61996 | ${}^mC_{es}T_{eo}T_{eo}{}^mC_{eo}{}^mC_{es}T_{ds}{}^mC_{ds}A_{ds}{}^mC_{ds}A_{ds}T_{ds}A_{ds}{}^mC_{ds}T_{ds}A_{eo}T_{eo}T_{es}A_{es}A_e$ | 3825 | 3903 |
| 890207 | N/A | N/A | 61978 | 61997 | $T_{es}{}^mC_{eo}T_{eo}T_{eo}T_{es}{}^mC_{ds}T_{ds}{}^mC_{ds}A_{ds}{}^mC_{ds}A_{ds}T_{ds}A_{ds}{}^mC_{ds}T_{ds}A_{ds}T_{eo}A_{eo}T_{es}T_{es}A_e$ | 3826 | 3904 |
| 890208 | N/A | N/A | 61979 | 61998 | ${}^mC_{es}T_{eo}{}^mC_{eo}T_{eo}T_{es}T_{ds}{}^mC_{ds}T_{ds}{}^mC_{ds}A_{ds}{}^mC_{ds}A_{ds}T_{ds}A_{ds}{}^mC_{ds}{}^mC_{eo}T_{eo}A_{es}T_{es}T_e$ | 3827 | 3905 |
| 890209 | N/A | N/A | 61980 | 61999 | $T_{es}{}^mC_{eo}T_{eo}{}^mC_{eo}T_{es}T_{ds}T_{ds}{}^mC_{ds}T_{ds}{}^mC_{ds}A_{ds}{}^mC_{ds}A_{ds}T_{ds}A_{ds}{}^mC_{eo}{}^mC_{eo}T_{es}A_{es}T_e$ | 3828 | 3906 |
| 934514 | 879 | 898 | 21710 | 21729 | $T_{es}G_{eo}{}^mC_{es}T_{es}T_{es}T_{ds}{}^mC_{ds}A_{ds}T_{ds}A_{ds}G_{ds}$ ... | 862 | 3907 |
| 934515 | 880 | 899 | 21711 | 21730 | $A_{es}T_{eo}G_{es}{}^mC_{es}T_{es}T_{ds}T_{ds}{}^mC_{ds}A_{ds}T_{ds}A_{ds}G_{ds}{}^mC_{ds}T_{ds}T_{ds}{}^mC_{es}{}^mC_{eo}A_{es}{}^mC_{es}{}^mC_e$ | 863 | 3908 |
| 934516 | 837 | 856 | 21668 | 21687 | $G_{es}{}^mC_{eo}{}^mC_{es}A_{es}{}^mC_{es}T_{ds}{}^mC_{ds}A_{ds}T_{ds}G_{ds}A_{ds}G_{ds}{}^mC_{ds}A_{ds}{}^mC_{ds}T_{es}T_{eo}{}^mC_{es}{}^mC_{es}A_e$ | 2833 | 3909 |
| 934517 | 840 | 859 | 21671 | 21690 | $A_{es}T_{eo}T_{es}G_{es}{}^mC_{es}{}^mC_{ds}{}^mC_{ds}A_{ds}{}^mC_{ds}T_{ds}{}^mC_{ds}A_{ds}T_{ds}G_{ds}A_{ds}G_{ds}G_{es}A_{eo}{}^mC_{es}T_{es}T_e$ | 3362 | 3910 |
| 934517 | 840 | 859 | 21671 | 21690 | $A_{es}T_{eo}T_{es}G_{es}{}^mC_{es}{}^mC_{ds}{}^mC_{ds}A_{ds}{}^mC_{ds}T_{ds}{}^mC_{ds}A_{ds}T_{ds}G_{ds}A_{ds}G_{ds}G_{es}A_{eo}{}^mC_{es}T_{es}T_e$ | 3362 | 3911 |
| 934518 | 846 | 865 | 21677 | 21696 | ${}^mC_{es}{}^mC_{eo}T_{es}G_{es}A_{es}{}^mC_{ds}A_{ds}T_{ds}G_{ds}{}^mC_{ds}{}^mC_{ds}A_{ds}{}^mC_{ds}T_{ds}{}^mC_{es}A_{eo}T_{es}G_{es}A_e$ | 3514 | 3912 |
| 934518 | 846 | 865 | 21677 | 21696 | ${}^mC_{es}{}^mC_{eo}T_{es}G_{es}A_{es}{}^mC_{ds}A_{ds}T_{ds}G_{ds}{}^mC_{ds}{}^mC_{ds}A_{ds}{}^mC_{ds}T_{ds}{}^mC_{es}A_{eo}T_{es}G_{es}A_e$ | 3514 | 3913 |
| 934519 | N/A | N/A | 23873 | 23892 | $T_{es}G_{eo}{}^mC_{es}A_{es}T_{es}T_{ds}T_{ds}{}^mC_{ds}T_{ds}T_{ds}T_{ds}A_{ds}T_{ds}G_{ds}A_{ds}A_{es}A_{eo}A_{es}{}^mC_{es}A_e$ | 2706 | 3914 |
| 934520 | 1233 | 1252 | 29584 | 29603 | $G_{es}A_{eo}G_{es}A_{es}T_{es}T_{ds}A_{ds}T_{ds}T_{ds}T_{ds}A_{ds}G_{ds}T_{ds}G_{ds}{}^mC_{ds}{}^mC_{es}{}^mC_{eo}A_{es}G_{es}{}^mC_e$ | 3287 | 3915 |
| 934521 | 1426 | 1445 | 35373 | 35392 | $G_{es}T_{eo}A_{es}T_{es}T_{es}{}^mC_{ds}T_{ds}{}^mC_{ds}T_{ds}T_{ds}T_{ds}T_{ds}G_{ds}A_{ds}T_{ds}A_{ds}A_{es}{}^mC_{eo}A_{es}G_{es}T_e$ | 917 | 3916 |
| 934522 | 1435 | 1454 | 35382 | 35401 | ${}^mC_{es}A_{eo}T_{es}T_{es}{}^mC_{es}A_{ds}G_{ds}G_{ds}T_{ds}G_{ds}T_{ds}A_{ds}T_{ds}T_{ds}{}^mC_{ds}{}^mC_{es}T_{eo}T_{es}T_{es}T_e$ | 918 | 3900 |
| 934523 | 1488 | 1507 | 35435 | 35454 | $G_{es}{}^mC_{eo}{}^mC_{es}A_{es}{}^mC_{es}T_{ds}T_{ds}T_{ds}{}^mC_{ds}A_{ds}G_{ds}{}^mC_{ds}{}^mC_{ds}A_{ds}{}^mC_{ds}T_{es}T_{eo}{}^mC_{es}A_{es}G_e$ | 922 | 3901 |
| 934524 | 1700 | 1719 | 41933 | 41952 | $A_{es}{}^mC_{eo}{}^mC_{es}A_{es}T_{es}A_{ds}T_{ds}T_{ds}A_{ds}G_{ds}{}^mC_{ds}T_{ds}T_{ds}A_{ds}T_{es}G_{eo}A_{es}T_{es}G_e$ | 3670 | 3917 |
| 934525 | 1701 | 1720 | 41934 | 41953 | $A_{es}A_{eo}{}^mC_{es}{}^mC_{es}A_{es}T_{ds}A_{ds}T_{ds}T_{ds}A_{ds}G_{ds}{}^mC_{ds}T_{ds}T_{ds}A_{es}T_{eo}G_{es}A_{es}T_e$ | 3365 | 3918 |
| 934526 | N/A | N/A | 48094 | 48113 | $T_{es}G_{eo}{}^mC_{es}A_{es}T_{es}A_{ds}G_{ds}T_{ds}{}^mC_{ds}T_{ds}G_{ds}T_{ds}A_{ds}G_{ds}G_{ds}T_{es}A_{eo}G_{es}T_{es}A_e$ | 2260 | 3919 |
| 934528 | 2267 | 2286 | 56275 | 56294 | ${}^mC_{es}T_{eo}G_{es}T_{es}T_{es}A_{ds}T_{ds}A_{ds}T_{ds}{}^mC_{ds}T_{ds}G_{ds}A_{ds}T_{ds}{}^mC_{ds}{}^mC_{es}A_{eo}{}^mC_{es}G_{es}{}^mC_e$ | 2685 | 3920 |
| 934529 | 2452 | 2471 | 62073 | 62092 | $T_{es}G_{eo}T_{es}{}^mC_{es}A_{es}{}^mC_{ds}A_{ds}{}^mC_{ds}T_{ds}T_{ds}T_{ds}{}^mC_{ds}{}^mC_{ds}{}^mC_{ds}A_{ds}A_{ds}T_{es}G_{eo}{}^mC_{es}T_{es}T_e$ | 3366 | 3921 |
| 934530 | 2453 | 2472 | 62074 | 62093 | ${}^mC_{es}T_{eo}G_{es}T_{es}{}^mC_{es}A_{ds}{}^mC_{ds}A_{ds}{}^mC_{ds}T_{ds}T_{ds}T_{ds}{}^mC_{ds}{}^mC_{ds}{}^mC_{ds}A_{ds}A_{es}T_{eo}G_{es}{}^mC_{es}T_e$ | 3443 | 3922 |
| 934531 | 2454 | 2473 | 62075 | 62094 | $G_{es}{}^mC_{eo}T_{es}G_{es}T_{es}{}^mC_{ds}A_{ds}{}^mC_{ds}A_{ds}{}^mC_{ds}T_{ds}T_{ds}T_{ds}{}^mC_{ds}{}^mC_{ds}{}^mC_{ds}A_{es}A_{eo}T_{es}G_{es}{}^mC_e$ | 3518 | 3923 |
| 934532 | 2456 | 2475 | 62077 | 62096 | $T_{es}G_{eo}G_{es}{}^mC_{es}T_{es}G_{ds}T_{ds}{}^mC_{ds}A_{ds}{}^mC_{ds}A_{ds}{}^mC_{ds}T_{ds}T_{ds}T_{ds}{}^mC_{ds}{}^mC_{es}{}^mC_{eo}A_{es}A_{es}T_e$ | 3595 | 3924 |
| 934533 | 2363 | 2382 | 61984 | 62003 | ${}^mC_{es}T_{eo}G_{es}{}^mC_{es}T_{es}{}^mC_{ds}T_{ds}{}^mC_{ds}T_{ds}{}^mC_{ds}T_{ds}T_{ds}T_{ds}T_{ds}{}^mC_{ds}{}^mC_{ds}{}^mC_{es}A_{eo}T_{es}A_{es}{}^mC_e$ | 258 | 3925 |
| 934534 | 2871 | 2890 | 71714 | 71733 | ${}^mC_{es}T_{eo}G_{es}T_{es}A_{es}A_{ds}T_{ds}A_{ds}{}^mC_{ds}A_{ds}G_{ds}G_{ds}{}^mC_{ds}A_{ds}T_{ds}{}^mC_{ds}T_{es}{}^mC_{eo}G_{es}G_{es}T_e$ | 3140 | 3926 |
| 934535 | N/A | N/A | 73941 | 73960 | ${}^mC_{es}A_{eo}G_{es}A_{es}T_{es}{}^mC_{ds}T_{ds}G_{ds}G_{ds}T_{ds}T_{ds}C_{ds}{}^mC_{ds}A_{ds}T_{ds}T_{es}G_{eo}{}^mC_{es}{}^mC_{es}T_e$ | 3636 | 3927 |
| 934536 | 3582 | 3601 | 77331 | 77350 | $G_{es}{}^mC_{eo}{}^mC_{es}A_{es}{}^mC_{es}T_{ds}G_{ds}G_{ds}A_{ds}A_{ds}A_{ds}{}^mC_{ds}T_{ds}{}^mC_{ds}T_{ds}{}^mC_{ds}{}^mC_{es}A_{eo}{}^mC_{es}T_{es}T_e$ | 219 | 3928 |
| 934537 | 3850 | 3869 | 82195 | 82214 | $G_{es}T_{eo}T_{es}T_{es}{}^mC_{es}T_{ds}{}^mC_{ds}T_{ds}A_{ds}{}^mC_{ds}T_{ds}{}^mC_{ds}T_{ds}A_{ds}G_{ds}A_{ds}{}^mC_{eo}{}^mC_{es}A_{es}T_e$ | 3369 | 3929 |
| 934538 | 3852 | 3871 | 82197 | 82216 | ${}^mC_{es}A_{eo}G_{es}T_{es}T_{es}T_{ds}{}^mC_{ds}T_{ds}{}^mC_{ds}T_{ds}A_{ds}{}^mC_{ds}T_{ds}{}^mC_{ds}T_{ds}A_{es}G_{eo}A_{es}{}^mC_{es}{}^mC_e$ | 3446 | 3930 |

TABLE 71-continued

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO Unmodified | SEQ ID NO Modified |
|---|---|---|---|---|---|---|---|
| 934540 | N/A | N/A | 91040 | 91059 | A$_{es}$T$_{eo}$G$_{es}$T$_{es}$A$_{es}$T$_{ds}$$^m$C$_{ds}$T$_{ds}$$^m$C$_{ds}$T$_{ds}$T$_{ds}$A$_{ds}$A$_{ds}$$^m$C$_{ds}$$^m$C$_{ds}$$^m$C$_{es}$A$_{eo}$G$_{es}$A$_{es}$G$_e$ | 1828 | 3931 |
| 934541 | N/A | N/A | 91041 | 91060 | $^m$C$_{es}$A$_{eo}$T$_{es}$G$_{es}$T$_{es}$A$_{ds}$T$_{ds}$$^m$C$_{ds}$T$_{ds}$$^m$C$_{ds}$T$_{ds}$T$_{ds}$A$_{ds}$A$_{ds}$$^m$C$_{ds}$$^m$C$_{es}$$^m$C$_{eo}$A$_{es}$G$_{es}$A$_e$ | 1829 | 3932 |
| 934542 | N/A | N/A | 91046 | 91065 | G$_{es}$T$_{eo}$T$_{es}$T$_{es}$T$_{es}$$^m$C$_{ds}$A$_{ds}$T$_{ds}$G$_{ds}$T$_{ds}$A$_{ds}$T$_{ds}$$^m$C$_{ds}$T$_{ds}$$^m$C$_{ds}$T$_{es}$T$_{eo}$A$_{es}$A$_{es}$$^m$C$_e$ | 1833 | 3933 |
| 934543 | N/A | N/A | 91047 | 91066 | T$_{es}$G$_{eo}$T$_{es}$T$_{es}$T$_{es}$T$_{ds}$$^m$C$_{ds}$A$_{ds}$T$_{ds}$G$_{ds}$T$_{ds}$A$_{ds}$T$_{ds}$$^m$C$_{ds}$T$_{ds}$$^m$C$_{ds}$T$_{es}$T$_{eo}$A$_{es}$A$_e$ | 1834 | 3934 |
| 934544 | N/A | N/A | 91048 | 91067 | $^m$C$_{es}$T$_{eo}$G$_{es}$T$_{es}$T$_{es}$T$_{ds}$T$_{ds}$$^m$C$_{ds}$A$_{ds}$T$_{ds}$G$_{ds}$T$_{ds}$A$_{ds}$T$_{ds}$$^m$C$_{ds}$T$_{es}$$^m$C$_{eo}$T$_{es}$T$_{es}$A$_e$ | 1835 | 3935 |
| 934545 | 4727 | 4746 | 92150 | 92169 | G$_{es}$G$_{eo}$$^m$C$_{es}$A$_{es}$$^m$C$_{es}$A$_{ds}$T$_{ds}$T$_{ds}$T$_{ds}$T$_{ds}$A$_{ds}$$^m$C$_{ds}$Gi$_{ds}$$^m$C$_{ds}$T$_{es}$$^m$C$_{eo}$$^m$C$_{es}$G$_{es}$A$_e$ | 2690 | 3936 |
| 934546 | 5073 | 5092 | 98221 | 98240 | $^m$C$_{es}$T$_{eo}$G$_{es}$G$_{es}$A$_{es}$A$_{ds}$T$_{ds}$T$_{ds}$T$_{ds}$T$_{ds}$T$_{ds}$$^m$C$_{ds}$T$_{ds}$A$_{ds}$G$_{es}$A$_{eo}$G$_{es}$$^m$C$_{es}$T$_e$ | 3524 | 3937 |
| 934547 | N/A | N/A | 91042 | 91061 | T$_{es}$$^m$C$_{eo}$A$_{es}$T$_{es}$G$_{es}$T$_{ds}$A$_{ds}$T$_{ds}$$^m$C$_{ds}$T$_{ds}$$^m$C$_{ds}$T$_{ds}$T$_{ds}$A$_{ds}$A$_{ds}$$^m$C$_{es}$$^m$C$_{eo}$$^m$C$_{es}$A$_{es}$G$_e$ | 1830 | 3938 |
| 934548 | 541 | 560 | 13807 | 13826 | T$_{es}$A$_{eo}$$^m$C$_{es}$$^m$C$_{es}$T$_{es}$G$_{ds}$A$_{ds}$A$_{ds}$G$_{ds}$T$_{ds}$T$_{ds}$A$_{ds}$G$_{ds}$A$_{ds}$G$_{es}$G$_{eo}$A$_{es}$G$_{es}$A$_e$ | 828 | 3939 |
| 934549 | 540 | 559 | 13806 | 13825 | A$_{es}$$^m$C$_{eo}$$^m$C$_{es}$T$_{es}$G$_{es}$A$_{ds}$A$_{ds}$G$_{ds}$T$_{ds}$T$_{ds}$A$_{ds}$G$_{ds}$G$_{ds}$A$_{ds}$G$_{es}$A$_{eo}$G$_{es}$A$_{es}$T$_e$ | 827 | 3940 |
| 934552 | 734 | 753 | 18633 | 18652 | G$_{es}$$^m$C$_{eo}$A$_{es}$$^m$C$_{es}$T$_{es}$T$_{ds}$A$_{ds}$A$_{ds}$$^m$C$_{ds}$A$_{ds}$A$_{ds}$T$_{ds}$T$_{ds}$$^m$C$_{ds}$A$_{es}$T$_{eo}$A$_{es}$T$_{es}$A$_e$ | 3513 | 3941 |
| 934553 | 737 | 756 | 18636 | 18655 | A$_{es}$A$_{eo}$$^m$C$_{es}$G$_{es}$$^m$C$_{es}$A$_{ds}$$^m$C$_{ds}$T$_{ds}$T$_{ds}$A$_{ds}$A$_{ds}$$^m$C$_{ds}$A$_{ds}$A$_{ds}$T$_{es}$T$_{eo}$$^m$C$_{es}$A$_{es}$T$_e$ | 1997 | 3942 |
| 934554 | 738 | 757 | 18637 | 18656 | T$_{es}$A$_{eo}$A$_{es}$$^m$C$_{es}$G$_{es}$$^m$C$_{ds}$A$_{ds}$$^m$C$_{ds}$T$_{ds}$T$_{ds}$A$_{ds}$A$_{ds}$$^m$C$_{ds}$A$_{ds}$A$_{ds}$T$_{es}$A$_{eo}$$^m$C$_{es}$A$_e$ | 2073 | 3943 |
| 934555 | 740 | 759 | 18639 | 18658 | G$_{es}$T$_{eo}$T$_{es}$A$_{es}$A$_{es}$$^m$C$_{ds}$G$_{ds}$$^m$C$_{ds}$A$_{ds}$$^m$C$_{ds}$T$_{ds}$T$_{ds}$A$_{ds}$A$_{ds}$$^m$C$_{ds}$A$_{es}$A$_{eo}$T$_{es}$A$_{es}$T$_e$ | 2148 | 3944 |
| 934556 | 735 | 754 | 18634 | 18653 | $^m$C$_{es}$G$_{eo}$$^m$C$_{es}$A$_{es}$$^m$C$_{es}$T$_{ds}$T$_{ds}$A$_{ds}$A$_{ds}$$^m$C$_{ds}$A$_{ds}$A$_{ds}$T$_{ds}$T$_{ds}$$^m$C$_{es}$A$_{eo}$T$_{es}$A$_{es}$T$_e$ | 852 | 3854 |
| 934557 | 736 | 755 | 18635 | 18654 | A$_{es}$$^m$C$_{eo}$G$_{es}$$^m$C$_{es}$A$_{es}$$^m$C$_{ds}$T$_{ds}$T$_{ds}$A$_{ds}$A$_{ds}$$^m$C$_{ds}$A$_{ds}$A$_{ds}$T$_{ds}$T$_{es}$$^m$C$_{eo}$A$_{es}$T$_{es}$A$_e$ | 3590 | 3945 |
| 934558 | N/A | N/A | 19521 | 19540 | A$_{es}$G$_{eo}$$^m$C$_{es}$A$_{es}$A$_{es}$T$_{ds}$$^m$C$_{ds}$A$_{ds}$T$_{ds}$T$_{ds}$G$_{ds}$G$_{ds}$T$_{ds}$A$_{ds}$G$_{ds}$$^m$C$_{es}$A$_{eo}$T$_{es}$A$_{es}$$^m$C$_e$ | 3385 | 3946 |
| 934584 | 7772 | 7791 | 145941 | 145960 | A$_{es}$$^m$C$_{eo}$$^m$C$_{es}$$^m$C$_{es}$T$_{es}$T$_{ds}$I$_{ds}$$^m$C$_{ds}$$^m$C$_{ds}$A$_{ds}$T$_{ds}$G$_{ds}$T$_{ds}$G$_{ds}$A$_{ds}$A$_{es}$$^m$C$_{eo}$A$_{es}$T$_{es}$T$_e$ | 1431 | 3947 |
| 934585 | 7780 | 7799 | 145949 | 145968 | A$_{es}$T$_{eo}$G$_{es}$T$_{es}$G$_{es}$A$_{ds}$G$_{ds}$T$_{ds}$A$_{ds}$$^m$C$_{ds}$$^m$C$_{ds}$$^m$C$_{ds}$T$_{ds}$T$_{ds}$T$_{ds}$$^m$C$_{es}$$^m$C$_{eo}$A$_{es}$T$_{es}$G$_e$ | 1438 | 3948 |
| 934586 | 732 | 751 | 18631 | 18650 | A$_{es}$$^m$C$_{eo}$T$_{es}$T$_{es}$A$_{es}$A$_{ds}$$^m$C$_{ds}$A$_{ds}$A$_{ds}$T$_{ds}$A$_{ds}$T$_{ds}$$^m$C$_{ds}$A$_{ds}$T$_{ds}$A$_{es}$T$_{eo}$A$_{es}$A$_{es}$T$_e$ | 3361 | 3949 |
| 934587 | 733 | 752 | 18632 | 18651 | $^m$C$_{es}$A$_{eo}$$^m$C$_{es}$T$_{es}$T$_{es}$A$_{ds}$A$_{ds}$$^m$C$_{ds}$A$_{ds}$A$_{ds}$T$_{ds}$A$_{ds}$T$_{ds}$$^m$C$_{ds}$A$_{ds}$T$_{es}$A$_{eo}$T$_{es}$A$_{es}$A$_e$ | 3438 | 3950 |
| 934588 | 2451 | 2470 | 62072 | 62091 | G$_{es}$T$_{eo}$$^m$C$_{es}$A$_{es}$$^m$C$_{es}$$^m$C$_{ds}$T$_{ds}$T$_{ds}$T$_{ds}$$^m$C$_{ds}$$^m$C$_{ds}$A$_{ds}$A$_{ds}$T$_{ds}$G$_{es}$$^m$C$_{eo}$T$_{es}$T$_{es}$A$_e$ | 188 | 3951 |
| 934589 | 835 | 854 | 21666 | 21685 | $^m$C$_{es}$A$_{eo}$$^m$C$_{es}$T$_{es}$$^m$C$_{es}$A$_{ds}$T$_{ds}$G$_{ds}$A$_{ds}$G$_{ds}$G$_{ds}$A$_{ds}$$^m$C$_{ds}$T$_{ds}$$^m$C$_{es}$$^m$C$_{eo}$A$_{es}$$^m$C$_{es}$A$_e$ | 860 | 3952 |
| 934590 | 836 | 855 | 21667 | 21686 | $^m$C$_{es}$$^m$C$_{eo}$A$_{es}$$^m$C$_{es}$T$_{es}$$^m$C$_{ds}$A$_{ds}$T$_{ds}$G$_{ds}$A$_{ds}$G$_{ds}$G$_{ds}$A$_{ds}$$^m$C$_{ds}$T$_{es}$$^m$C$_{eo}$$^m$C$_{es}$A$_{es}$$^m$C$_e$ | 2757 | 3953 |
| 934591 | 834 | 853 | 21665 | 21684 | A$_{es}$$^m$C$_{eo}$T$_{es}$$^m$C$_{es}$A$_{es}$T$_{ds}$G$_{ds}$A$_{ds}$G$_{ds}$G$_{ds}$A$_{ds}$$^m$C$_{ds}$T$_{ds}$$^m$C$_{ds}$$^m$C$_{es}$A$_{eo}$$^m$C$_{es}$A$_{es}$T$_e$ | 3286 | 3954 |
| 934592 | 2362 | 2381 | 61983 | 62002 | T$_{es}$G$_{eo}$$^m$C$_{es}$T$_{es}$$^m$C$_{es}$T$_{ds}$$^m$C$_{ds}$T$_{ds}$T$_{ds}$T$_{ds}$$^m$C$_{ds}$T$_{ds}$$^m$C$_{ds}$A$_{ds}$$^m$C$_{ds}$A$_{es}$T$_{eo}$A$_{es}$$^m$C$_{es}$$^m$C$_e$ | 257 | 3955 |
| 934593 | 896 | 915 | 21727 | 21746 | $^m$C$_{es}$T$_{eo}$T$_{es}$T$_{es}$$^m$C$_{es}$A$_{ds}$$^m$C$_{ds}$T$_{ds}$$^m$C$_{ds}$A$_{ds}$T$_{ds}$A$_{ds}$G$_{ds}$G$_{ds}$G$_{es}$A$_{eo}$T$_{es}$G$_{es}$$^m$C$_e$ | 291 | 3956 |
| 934594 | 2365 | 2384 | 61986 | 62005 | G$_{es}$A$_{eo}$$^m$C$_{es}$T$_{es}$G$_{es}$$^m$C$_{ds}$T$_{ds}$$^m$C$_{ds}$T$_{ds}$$^m$C$_{ds}$T$_{ds}$T$_{ds}$T$_{ds}$$^m$C$_{ds}$T$_{ds}$$^m$C$_{es}$A$_{eo}$$^m$C$_{es}$A$_{es}$T$_e$ | 1017 | 3957 |
| 934595 | 2364 | 2383 | 61985 | 62004 | A$_{es}$$^m$C$_{eo}$T$_{es}$G$_{es}$$^m$C$_{es}$T$_{ds}$$^m$C$_{ds}$T$_{ds}$$^m$C$_{ds}$T$_{ds}$T$_{ds}$T$_{ds}$$^m$C$_{ds}$T$_{ds}$$^m$C$_{ds}$A$_{es}$$^m$C$_{eo}$A$_{es}$T$_{es}$A$_e$ | 259 | 3958 |
| 934596 | 542 | 561 | 13808 | 13827 | T$_{es}$T$_{eo}$A$_{es}$$^m$C$_{es}$$^m$C$_{es}$T$_{ds}$G$_{ds}$A$_{ds}$A$_{ds}$G$_{ds}$T$_{ds}$T$_{ds}$A$_{ds}$G$_{ds}$G$_{ds}$A$_{es}$G$_{eo}$G$_{es}$A$_{es}$G$_e$ | 829 | 3959 |
| 934597 | 4112 | 4131 | 86607 | 86626 | A$_{es}$G$_{eo}$T$_{es}$T$_{es}$T$_{es}$$^m$C$_{ds}$A$_{ds}$T$_{ds}$T$_{ds}$$^m$C$_{ds}$G$_{ds}$G$_{ds}$T$_{ds}$T$_{ds}$A$_{ds}$T$_{es}$A$_{eo}$A$_{es}$G$_{es}$G$_e$ | 1172 | 3960 |
| 934599 | 2368 | 2387 | 61989 | 62008 | T$_{es}$G$_{eo}$G$_{es}$G$_{es}$A$_{es}$$^m$C$_{ds}$T$_{ds}$G$_{ds}$$^m$C$_{ds}$T$_{ds}$$^m$C$_{ds}$T$_{ds}$T$_{ds}$T$_{es}$$^m$C$_{eo}$T$_{es}$$^m$C$_{es}$A$_e$ | 185 | 3961 |
| 934600 | 2369 | 2388 | 61990 | 62009 | T$_{es}$T$_{eo}$G$_{es}$G$_{es}$G$_{es}$A$_{ds}$$^m$C$_{ds}$T$_{ds}$G$_{ds}$$^m$C$_{ds}$T$_{ds}$$^m$C$_{ds}$T$_{ds}$$^m$C$_{ds}$T$_{ds}$T$_{es}$T$_{eo}$$^m$C$_{es}$T$_{es}$$^m$C$_e$ | 1019 | 3962 |
| 952334 | 607 | 626 | 16127 | 16146 | A$_{es}$G$_{eo}$$^m$C$_{es}$$^m$C$_{es}$A$_{ds}$T$_{ds}$G$_{ds}$G$_{ds}$$^m$C$_{ds}$A$_{ds}$T$_{ds}$$^m$C$_{ds}$A$_{ds}$A$_{ds}$A$_{es}$A$_{eo}$A$_{es}$T$_{es}$T$_e$ | 839 | 3963 |
| 952335 | 730 | 749 | 18629 | 18648 | T$_{es}$T$_{eo}$A$_{es}$A$_{es}$$^m$C$_{es}$A$_{ds}$A$_{ds}$T$_{ds}$A$_{ds}$T$_{ds}$$^m$C$_{ds}$A$_{ds}$T$_{ds}$A$_{ds}$T$_{ds}$A$_{es}$A$_{eo}$T$_{es}$$^m$C$_{es}$T$_e$ | 3666 | 3964 |
| 952336 | 872 | 891 | 21703 | 21722 | A$_{es}$T$_{eo}$A$_{es}$G$_{es}$$^m$C$_{es}$T$_{ds}$T$_{ds}$$^m$C$_{ds}$$^m$C$_{ds}$A$_{ds}$$^m$C$_{ds}$$^m$C$_{ds}$A$_{ds}$$^m$C$_{ds}$A$_{es}$A$_{es}$T$_{eo}$A$_{es}$T$_{es}$T$_e$ | 1998 | 3965 |

TABLE 71-continued

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO Unmodified | SEQ ID NO Modified |
|---|---|---|---|---|---|---|---|
| 952338 | 875 | 894 | 21706 | 21725 | $T_{es}T_{eo}{}^mC_{es}A_{es}T_{es}A_{ds}G_{ds}{}^mC_{ds}T_{ds}T_{ds}{}^mC_{ds}{}^mC_{ds}A_{ds}{}^mC_{ds}C_{ds}A_{es}{}^mC_{eo}A_{es}A_{es}T_e$ | 2149 | 3966 |
| 952340 | 877 | 896 | 21708 | 21727 | ${}^mC_{es}T_{eo}T_{es}T_{es}{}^mC_{es}A_{ds}T_{ds}A_{ds}G_{ds}{}^mC_{ds}T_{ds}T_{ds}{}^mC_{ds}{}^mC_{ds}A_{ds}{}^mC_{es}{}^mC_{eo}A_{es}{}^mC_{es}A_e$ | 2986 | 3967 |
| 952358 | 3227 | 3246 | 76361 | 76380 | $A_{es}A_{eo}G_{es}T_{es}{}^mC_{es}{}^mC_{ds}A_{ds}A_{ds}A_{ds}T_{ds}G_{ds}T_{ds}G_{ds}T_{ds}{}^mC_{ds}A_{es}A_{eo}A_{es}{}^mC_{es}T_e$ | 2534 | 3968 |
| 952359 | 3228 | 3247 | 76362 | 76381 | ${}^mC_{es}A_{eo}A_{es}G_{es}T_{es}{}^mC_{ds}{}^mC_{ds}A_{ds}A_{ds}A_{ds}T_{ds}G_{ds}T_{ds}G_{ds}T_{ds}{}^mC_{es}A_{eo}A_{es}A_{es}{}^mC_e$ | 2610 | 3969 |
| 952360 | 3229 | 3248 | 76363 | 76382 | $G_{es}{}^mC_{eo}A_{es}A_{es}G_{es}T_{ds}{}^mC_{ds}{}^mC_{ds}A_{ds}A_{ds}A_{ds}T_{ds}G_{ds}T_{ds}G_{ds}T_{es}{}^mC_{eo}A_{es}A_{es}A_e$ | 2687 | 3970 |
| 952361 | 3231 | 3250 | 76365 | 76384 | $G_{es}T_{eo}G_{es}{}^mC_{es}A_{es}A_{ds}G_{ds}T_{ds}{}^mC_{ds}{}^mC_{ds}A_{ds}A_{ds}A_{ds}T_{ds}G_{ds}T_{es}G_{eo}T_{es}{}^mC_{es}A_e$ | 3141 | 3971 |
| 952362 | 3498 | 3517 | 77247 | 77266 | ${}^mC_{es}T_{eo}T_{es}{}^mC_{es}A_{es}G_{ds}T_{ds}T_{ds}{}^mC_{ds}{}^mC_{ds}T_{ds}T_{ds}{}^mC_{ds}A_{ds}G_{ds}T_{es}{}^mC_{eo}T_{es}{}^mC_{es}A_e$ | 1110 | 3972 |
| 952363 | 3499 | 3518 | 77248 | 77267 | $T_{es}{}^mC_{eo}T_{es}T_{es}{}^mC_{es}A_{ds}G_{ds}T_{ds}T_{ds}{}^mC_{ds}{}^mC_{ds}T_{ds}T_{ds}{}^mC_{ds}A_{ds}G_{es}T_{eo}{}^mC_{es}T_{es}{}^mC_e$ | 1111 | 3973 |
| 952364 | 3505 | 3524 | 77254 | 77273 | $T_{es}T_{eo}A_{es}A_{es}A_{es}A_{ds}T_{ds}{}^mC_{ds}T_{ds}T_{ds}A_{ds}{}^mC_{ds}A_{ds}G_{ds}T_{ds}T_{ds}{}^mC_{es}{}^mC_{eo}T_{es}T_{es}{}^mC_e$ | 1112 | 3974 |
| 952365 | 3718 | 3737 | 82063 | 82082 | $T_{es}G_{eo}{}^mC_{es}T_{es}G_{es}{}^mC_{ds}T_{ds}{}^mC_{ds}A_{ds}T_{ds}A_{ds}T_{ds}{}^mC_{ds}T_{ds}A_{ds}A_{es}A_{eo}G_{es}A_{es}{}^mC_e$ | 1134 | 3975 |
| 952366 | 3719 | 3738 | 82064 | 82083 | $T_{es}T_{eo}G_{es}{}^mC_{es}T_{es}G_{ds}{}^mC_{ds}T_{ds}{}^mC_{ds}A_{ds}T_{ds}A_{ds}T_{ds}{}^mC_{ds}T_{ds}A_{ds}A_{es}A_{eo}A_{es}G_{es}A_e$ | 1135 | 3976 |
| 952367 | 3723 | 3742 | 82068 | 82087 | $A_{es}T_{eo}{}^mC_{es}A_{es}T_{es}T_{ds}G_{ds}{}^mC_{ds}T_{ds}G_{ds}{}^mC_{ds}T_{ds}{}^mC_{ds}A_{ds}T_{ds}A_{es}T_{eo}{}^mC_{es}T_{es}A_e$ | 1136 | 3977 |
| 952368 | 4106 | 4125 | 86601 | 86620 | $A_{es}T_{eo}T_{es}{}^mC_{es}G_{es}G_{ds}T_{ds}T_{ds}A_{ds}T_{ds}A_{ds}A_{ds}G_{ds}G_{ds}{}^mC_{ds}A_{es}{}^mC_{eo}A_{es}G_{es}{}^mC_e$ | 1167 | 3978 |
| 952369 | 4107 | 4126 | 86602 | 86621 | ${}^mC_{es}A_{eo}T_{es}T_{es}{}^mC_{es}G_{ds}G_{ds}T_{ds}T_{ds}A_{ds}T_{ds}A_{ds}A_{ds}G_{ds}G_{ds}{}^mC_{es}A_{eo}{}^mC_{es}A_{es}G_e$ | 1168 | 3979 |
| 952370 | 4108 | 4127 | 86603 | 86622 | $T_{es}{}^mC_{eo}A_{es}T_{es}T_{es}{}^mC_{ds}G_{ds}G_{ds}T_{ds}T_{ds}A_{ds}T_{ds}A_{ds}A_{ds}G_{ds}G_{es}{}^mC_{eo}A_{es}{}^mC_{es}A_e$ | 1169 | 3980 |
| 952371 | 4109 | 4128 | 86604 | 86623 | $T_{es}T_{eo}{}^mC_{es}A_{es}T_{es}T_{ds}{}^mC_{ds}G_{ds}G_{ds}T_{ds}T_{ds}A_{ds}T_{ds}A_{ds}A_{ds}G_{es}G_{eo}{}^mC_{es}A_{es}{}^mC_e$ | 1170 | 3981 |
| 952372 | 4110 | 4129 | 86605 | 86624 | $T_{es}T_{eo}T_{es}{}^mC_{es}A_{es}T_{ds}T_{ds}{}^mC_{ds}G_{ds}G_{ds}T_{ds}T_{ds}A_{ds}T_{ds}A_{ds}A_{es}G_{eo}{}^mC_{es}A_e$ | 1171 | 3982 |
| 952373 | 4111 | 4130 | 86606 | 86625 | $G_{es}T_{eo}T_{es}T_{es}{}^mC_{es}A_{ds}T_{ds}T_{ds}{}^mC_{ds}G_{ds}G_{ds}T_{ds}T_{ds}A_{ds}T_{ds}A_{es}A_{eo}G_{es}G_{es}{}^mC_e$ | 235 | 3983 |
| 952374 | 4115 | 4134 | 86610 | 86629 | $A_{es}T_{eo}A_{es}A_{es}G_{es}T_{ds}T_{ds}T_{ds}{}^mC_{ds}A_{ds}T_{ds}T_{ds}{}^mC_{ds}G_{ds}G_{ds}T_{es}T_{eo}A_{es}T_{es}A_e$ | 1175 | 3984 |
| 952375 | 608 | 627 | 16128 | 16147 | $G_{es}A_{eo}G_{es}T_{es}G_{es}{}^mC_{ds}A_{ds}T_{ds}G_{ds}G_{ds}{}^mC_{ds}A_{ds}T_{ds}{}^mC_{ds}A_{ds}A_{es}A_{eo}A_{es}A_{es}T_e$ | 279 | 3985 |
| 952376 | 609 | 628 | 16129 | 16148 | $T_{es}G_{eo}A_{es}G_{es}T_{es}G_{ds}{}^mC_{ds}A_{ds}T_{ds}G_{ds}G_{ds}{}^mC_{ds}A_{ds}T_{ds}{}^mC_{ds}A_{es}A_{eo}A_{es}A_{es}A_e$ | 840 | 3986 |
| 952377 | 610 | 629 | 16130 | 16149 | $A_{es}T_{eo}G_{es}A_{es}G_{es}T_{ds}G_{ds}{}^mC_{ds}A_{ds}T_{ds}G_{ds}G_{ds}{}^mC_{ds}A_{ds}T_{ds}{}^mC_{es}A_{eo}A_{es}A_{es}A_e$ | 841 | 3987 |
| 952378 | 611 | 630 | 16131 | 16150 | $A_{es}A_{eo}T_{es}G_{es}A_{es}G_{ds}T_{ds}G_{ds}{}^mC_{ds}A_{ds}T_{ds}G_{ds}G_{ds}{}^mC_{ds}A_{ds}T_{es}{}^mC_{eo}A_{es}A_{es}A_e$ | 280 | 3988 |
| 952379 | 612 | 631 | 16132 | 16151 | $A_{es}A_{eo}A_{es}T_{es}G_{es}A_{ds}G_{ds}T_{ds}G_{ds}{}^mC_{ds}A_{ds}T_{ds}G_{ds}G_{ds}{}^mC_{ds}A_{es}T_{eo}{}^mC_{es}A_{es}A_e$ | 842 | 3989 |
| 952380 | 613 | 632 | 16133 | 16152 | $G_{es}A_{eo}A_{es}A_{es}T_{es}G_{ds}A_{ds}G_{ds}T_{ds}G_{ds}{}^mC_{ds}A_{ds}T_{ds}G_{ds}G_{ds}{}^mC_{es}A_{eo}T_{es}{}^mC_{es}A_e$ | 843 | 3990 |
| 952381 | 620 | 639 | 16140 | 16159 | $T_{es}T_{eo}G_{es}G_{es}{}^mC_{es}T_{ds}G_{ds}G_{ds}A_{ds}A_{ds}A_{ds}T_{ds}G_{ds}A_{ds}G_{ds}T_{es}G_{eo}{}^mC_{es}A_{es}T_e$ | 844 | 3991 |
| 953599 | 732 | 748 | 18631 | 18647 | $T_{es}A_{eo}A_{eo}{}^mC_{es}A_{ds}A_{ds}T_{ds}A_{ds}T_{ds}{}^mC_{ds}A_{ds}T_{ds}A_{ds}Tk_{o}A_{es}A_{es}T_e$ | 3829 | 3992 |
| 953600 | 733 | 749 | 18632 | 18648 | $T_{es}T_{eo}A_{eo}A_{es}{}^mC_{ds}A_{ds}A_{ds}T_{ds}A_{ds}T_{ds}{}^mC_{ds}A_{ds}T_{ds}Ak_{o}T_{es}A_{es}A_e$ | 3830 | 3993 |
| 953601 | 734 | 750 | 18633 | 18649 | ${}^mC_{es}T_{eo}T_{eo}A_{es}A_{ds}{}^mC_{ds}A_{ds}A_{ds}T_{ds}A_{ds}T_{ds}{}^mC_{ds}A_{ds}Tk_{o}A_{es}T_{es}A_e$ | 3831 | 3994 |
| 953602 | 735 | 751 | 18634 | 18650 | $A_{es}{}^mC_{eo}T_{eo}T_{es}A_{ds}A_{ds}{}^mC_{ds}A_{ds}A_{ds}T_{ds}A_{ds}T_{ds}{}^mC_{ds}Ak_{o}T_{es}A_{es}T_e$ | 3832 | 3995 |
| 953603 | 736 | 752 | 18635 | 18651 | ${}^mC_{es}A_{eo}{}^mC_{eo}T_{es}T_{ds}A_{ds}A_{ds}{}^mC_{ds}A_{ds}A_{ds}T_{ds}A_{ds}T_{ds}{}^mC_{ds}Ck_{o}A_{es}T_{es}A_e$ | 3833 | 3996 |
| 953604 | 1874 | 1890 | 52788 | 52804 | $A_{es}G_{eo}{}^mC_{eo}A_{es}{}^mC_{ds}T_{ds}G_{ds}A_{ds}A_{ds}T_{ds}{}^mC_{ds}{}^mC_{ds}A_{ds}Tk_{o}A_{es}G_{es}{}^mC_e$ | 3834 | 3997 |
| 953605 | 1791 | 1807 | 52705 | 52721 | $A_{es}{}^mC_{eo}A_{eo}T_{es}T_{ds}T_{ds}{}^mC_{ds}T_{ds}G_{ds}A_{ds}A_{ds}T_{ds}{}^mC_{ds}{}^mC_{ds}Ck_{o}{}^mC_{es}A_{es}G_e$ | 3835 | 3998 |
| 953606 | 3493 | 3509 | 77242 | 77258 | ${}^mC_{es}{}^mC_{eo}T_{eo}T_{es}{}^mC_{ds}A_{ds}G_{ds}T_{ds}T_{ds}{}^mC_{ds}{}^mC_{ds}T_{ds}{}^mC_{ds}A_{ds}A_{ds}Gk_{o}G_{es}G_{es}G_e$ | 3836 | 3999 |
| 953607 | 3713 | 3729 | 82058 | 82074 | $A_{es}T_{eo}A_{eo}T_{es}{}^mC_{ds}T_{ds}A_{ds}A_{ds}A_{ds}A_{ds}G_{ds}A_{ds}{}^mC_{ds}{}^mC_{ds}Gk_{o}{}^mC_{es}A_{es}A_e$ | 3837 | 4000 |
| 953608 | 987 | 1003 | 27962 | 27978 | $A_{es}A_{eo}A_{eo}{}^mC_{es}T_{ds}{}^mC_{ds}A_{ds}T_{ds}G_{ds}G_{ds}A_{ds}{}^mC_{ds}T_{ds}Tk_{o}{}^mC_{es}G_{es}T_e$ | 3838 | 4001 |

TABLE 71-continued

Modified oligonucleotides complementary to human LRRK2 RNA

| Compound Number | SEQ ID NO: 1 Start Site | SEQ ID NO: 1 Stop Site | SEQ ID NO: 2 Start Site | SEQ ID NO: 2 Stop Site | Sequence and chemistry notation (5' to 3') | SEQ ID NO Unmodified | SEQ ID NO Modified |
|---|---|---|---|---|---|---|---|
| 953609 | 4110 | 4126 | 86605 | 86621 | $^mC_{es}A_{eo}T_{eo}T_{es}{}^mC_{ds}G_{ds}G_{ds}T_{ds}T_{ds}A_{ds}T_{ds}A_{ds}A_{ds}Gk_oG_{es}{}^mC_{es}A_e$ | 3839 | 4002 |
| 953610 | 7775 | 7791 | 145944 | 145960 | $A_{es}{}^mC_{eo}{}^mC_{eo}{}^mC_{es}T_{ds}T_{ds}T_{ds}{}^mC_{ds}{}^mC_{ds}A_{ds}T_{ds}G_{ds}T_{ds}Gk_oA_{es}A_{es}{}^mC_e$ | 3840 | 4003 |
| 953611 | 879 | 895 | 21710 | 21726 | $T_{es}T_{eo}T_{eo}{}^mC_{es}A_{ds}T_{ds}A_{ds}G_{ds}{}^mC_{ds}T_{ds}T_{ds}{}^mC_{ds}{}^mC_{ds}Ak_o{}^mC_{es}{}^mC_{es}A_e$ | 3841 | 4004 |
| 953612 | 834 | 850 | 21665 | 21681 | $^mC_{es}A_{eo}T_{eo}G_{es}A_{ds}G_{ds}G_{ds}A_{ds}{}^mC_{ds}T_{ds}T_{ds}{}^mC_{ds}{}^mC_{ds}Ak_o{}^mC_{es}A_{es}T_e$ | 3842 | 4005 |
| 953613 | 606 | 622 | 16126 | 16142 | $^mC_{es}A_{eo}T_{eo}G_{es}G_{ds}{}^mC_{ds}A_{ds}T_{ds}{}^mC_{ds}A_{ds}A_{ds}A_{ds}Ak_oT_{es}T_{es}A_e$ | 3843 | 4006 |
| 953614 | 990 | 1006 | 27965 | 27981 | $^mC_{es}A_{eo}{}^mC_{eo}A_{es}A_{ds}A_{ds}{}^mC_{ds}T_{ds}{}^mC_{ds}A_{ds}T_{ds}G_{ds}G_{ds}Ak_o{}^mC_{es}T_{es}T_e$ | 3844 | 4007 |
| 953615 | 3497 | 3513 | 77246 | 77262 | $A_{es}G_{eo}T_{eo}T_{es}{}^mC_{ds}{}^mC_{ds}T_{ds}T_{ds}{}^mC_{ds}A_{ds}G_dT_{ds}{}^mC_{ds}Tk_o{}^mC_{es}A_{es}A_e$ | 3845 | 4008 |
| 953616 | 4108 | 4124 | 86603 | 86619 | $T_{es}T_{eo}{}^mC_{eo}G_{es}G_{ds}T_{ds}T_{ds}A_{ds}T_{ds}A_{ds}A_{ds}A_{ds}G_{ds}G_{ds}Ck_oA_{es}{}^mC_{es}A_e$ | 3846 | 4009 |
| 953617 | 1698 | 1714 | 41931 | 41947 | $A_{es}T_{eo}T_{eo}T_{es}A_{ds}G_{ds}{}^mC_{ds}T_{ds}T_{ds}A_{ds}T_{ds}G_{ds}A_{ds}Tk_oG_{es}A_{es}A_e$ | 3847 | 4010 |

Example 10: Effect of 5-10-5 MOE Gapmers with Mixed Internucleoside Linkages on Human LRRK2 RNA Expression In Vitro Via Free Uptake Modified oligonucleotides selected from the examples above were tested at various doses in A431 cells by free uptake. Cells were plated at a density of 10,000 cells per well with 0.039, 0.156, 0.625, 2.500 and 10.000 μM concentrations of modified oligonucleotide, as specified in the tables below. After a treatment period of approximately 24 hours, total RNA was isolated from the cells and LRRK2 RNA levels were measured by quantitative real-time PCR. Human LRRK2 primer probe set RTS3132 (described herein in Example 2) was used to measure RNA levels. LRRK2 RNA levels were adjusted according to total RNA content, as measured by RIBOGREEN® Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response–variable slope (4 parameters)" formula using Prism6 software.

TABLE 72

Dose-dependent reduction of human LRRK2 expression in A431 cells by free uptake

| Compound Number | LRRK2 expression (% control) | | | | | $IC_{50}$ (μM) |
|---|---|---|---|---|---|---|
| | 0.039 μM | 0.156 μM | 0.625 μM | 2.500 μM | 10.000 μM | |
| 780160 | 101 | 86 | 56 | 55 | 48 | 4.5 |
| 780161 | 102 | 85 | 58 | 31 | 45 | 1.9 |
| 780164 | 95 | 75 | 63 | 52 | 40 | 3.1 |
| 780166 | 94 | 42 | 42 | 31 | 32 | 0.4 |
| 780241 | 70 | 70 | 46 | 35 | 50 | 1.3 |
| 802655 | 81 | 76 | 58 | 52 | 36 | 2.3 |
| 802665 | 78 | 73 | 62 | 59 | 53 | 14.3 |
| 802678 | 77 | 44 | 28 | 24 | 26 | 0.2 |
| 802714 | 84 | 84 | 64 | 47 | 40 | 2.8 |
| 802758 | 84 | 51 | 25 | 23 | 29 | 0.2 |
| 802770 | 74 | 68 | 44 | 28 | 31 | 0.5 |
| 802784 | 88 | 70 | 37 | 20 | 25 | 0.5 |

TABLE 72-continued

Dose-dependent reduction of human LRRK2 expression in A431 cells by free uptake

| Compound Number | LRRK2 expression (% control) | | | | | $IC_{50}$ (μM) |
|---|---|---|---|---|---|---|
| | 0.039 μM | 0.156 μM | 0.625 μM | 2.500 μM | 10.000 μM | |
| 802938 | 109 | 53 | 50 | 38 | 34 | 1.0 |
| 802939 | 96 | 80 | 63 | 44 | 31 | 1.9 |
| 802963 | 92 | 102 | 88 | 78 | 64 | 26.0 |
| 803000 | 85 | 84 | 60 | 30 | 33 | 1.3 |
| 803006 | 89 | 77 | 53 | 43 | 37 | 1.7 |
| 803268 | 90 | 93 | 55 | 46 | 27 | 1.7 |
| 803270 | 86 | 80 | 52 | 44 | 43 | 2.2 |
| 872255 | 96 | 67 | 36 | 29 | 22 | 0.5 |
| 872260 | 52 | 55 | 33 | 23 | 29 | 0.1 |
| 876031 | 96 | 60 | 33 | 21 | 20 | 0.4 |
| 876180 | 101 | 94 | 90 | 90 | 80 | >300 |
| 876190 | 81 | 68 | 36 | 24 | 23 | 0.4 |
| 876604 | 91 | 71 | 46 | 28 | 41 | 0.0 |
| 934517 | 80 | 86 | 43 | 38 | 48 | 0.9 |
| 934518 | 82 | 54 | 28 | 25 | 31 | 1.8 |
| 934523 | 71 | 49 | 30 | 15 | 23 | 0.3 |
| 934528 | 71 | 57 | 50 | 26 | 34 | 0.2 |
| 934529 | 76 | 43 | 24 | 27 | 29 | 0.4 |
| 934530 | 89 | 68 | 40 | 28 | 25 | 0.2 |
| 934553 | 99 | 73 | 51 | 33 | 31 | 0.6 |
| 934554 | 95 | 73 | 72 | 40 | 35 | 1.0 |
| 934556 | 63 | 59 | 41 | 26 | 28 | 2.1 |
| 934557 | 107 | 63 | 51 | 33 | 33 | 0.3 |

Example 11: Effect of Modified Oligonucleotides on Rhesus Monkey LRRK2 RNA In Vitro, Multiple Doses Modified oligonucleotides selected from the examples above, which are also complementary to rhesus monkey LRRK2 were tested at various doses in LLC-MK2 monkey cells. Cells were plated at a density of 20,000 cells per well and transfected using electroporation with 0.011, 0.034, 0.103, 0.309, 0.926, 2.778, 8.333, and 25,000 μM concentrations of modified oligonucleotide, as specified in the tables below. Also tested were control oligonucleotides, 676630, a 5-10-5 MOE gapmer with mixed phosphodiester and phosphorothioate backbone with no known target and the sequence CCTATAGGACTATCCAGGAA (SEQ TD NO: 3848). After a treatment period of approximately 24 hours, total RNA was isolated from the cells and LRRK2 RNA levels were measured by quantitative real-time PCR. Human LRRK2 primer probe set hLRRK2 LTS35700 (forward sequence CCAGGTACAATGCAAAGCTTAAT, designated herein as SEQ ID NO: 20; reverse sequence TCAGTCCAATCACTGACAAGTT, designated herein as SEQ ID NO: 21; probe sequence TTGG-GAAGTCCTTGGTGTTCACCA, designated herein as SEQ ID NO: 22) was used to measure RNA levels. LRRK2 RNA levels were adjusted according to total RNA content, as measured by RIBOGREEN Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response–variable slope (4 parameters)" formula using Prism6 software.

TABLE 73

Dose-dependent reduction of human LRRK2 expression in LLC-MK2 rhesus monkey cells

| Compound Number | \multicolumn{8}{c}{LRRK2 expression (% control)} | | | | | | | | $IC_{50}$ (µM) |
|---|---|---|---|---|---|---|---|---|---|
| | 0.011 µM | 0.034 µM | 0.103 µM | 0.309 µM | 0.926 µM | 2.778 µM | 8.333 µM | 25.000 µM | |
| 676630 | 118 | 114 | 124 | 128 | 123 | 134 | 125 | 125 | n/a# |
| 780241 | 114 | 118 | 116 | 92 | 67 | 51 | 46 | 41 | 6.4 |
| 802714** | 122 | 116 | 130 | 131 | 112 | 80 | 41 | 20 | 7.4 |
| 803268* | 101 | 109 | 105 | 112 | 108 | 89 | 76 | 69 | 50.4 |
| 876031 | 122 | 113 | 106 | 84 | 46 | 14 | 8 | 1 | 0.9 |
| 876604** | 97 | 95 | 99 | 97 | 107 | 107 | 105 | 77 | n/a# |
| 934556 | 88 | 84 | 71 | 55 | 30 | 12 | 11 | 6 | 0.3 |

$IC_{50}$ value cannot be calculated
*This modified oligonucleotide is complementary to and contains one mismatch to rhesus monkey LRRK2 nucleic acid SEQ ID NO: 3
**These modified oligonucleotides are complementary to and contain two mismatches to rhesus monkey LRRK2 nucleic acid SEQ ID NO: 3

TABLE 74

Dose-dependent reduction of human LRRK2 expression in SH-SY5Y Cells

| Compound Number | \multicolumn{8}{c}{LRRK2 expression (% control)} | | | | | | | | $IC_{50}$ (µM) |
|---|---|---|---|---|---|---|---|---|---|
| | 0.011 µM | 0.034 µM | 0.103 µM | 0.309 µM | 0.926 µM | 2.778 µM | 8.333 µM | 25.000 µM | |
| Control 676630 | 129 | 113 | 108 | 133 | 109 | 131 | 122 | 133 | n/a* |
| 780241 | 117 | 104 | 92 | 93 | 76 | 59 | 58 | 58 | n/a* |
| 802714 | 100 | 123 | 98 | 93 | 75 | 56 | 44 | 36 | 6.3 |
| 803268 | 99 | 121 | 96 | 83 | 77 | 84 | 73 | 68 | 105.6 |
| 876031 | 96 | 99 | 93 | 73 | 49 | 22 | 18 | 15 | 1.0 |
| 876604 | 97 | 91 | 78 | 65 | 43 | 20 | 15 | 15 | 0.6 |
| 934556 | 97 | 90 | 77 | 55 | 42 | 27 | 20 | 15 | 0.6 |

*$IC_{50}$ value cannot be calculated

Example 12: Effect of Modified Oligonucleotides on Human LRRK2 RNA Expression In Vitro, Multiple Doses Modified oligonucleotides described above were tested at various doses in SH-SY5Y cells. Cells were plated at a density of 20,000 cells per well and transfected using electroporation with 0.011, 0.034, 0.103, 0.309, 0.926, 2.778, 8.333, and 25,000 µM of modified oligonucleotide, as specified in the tables below. Also tested was control oligonucleotide, 676630, a 5-10-5 MOE gapmer with mixed phosphodiester and phosphorothioate backbone with no known target. After a treatment period of approximately 24 hours, total RNA was isolated from the cells and LRRK2 RNA levels were measured by quantitative real-time PCR. Human LRRK2 primer probe set LTS35700 (described herein in Example 11) was used to measure RNA levels. LRRK2 RNA levels were adjusted according to total RNA content, as measured by RIBOGREEN Results are presented in the table below as percent LRRK2 RNA levels relative to untreated control cells. As illustrated in the tables below, LRRK2 RNA levels were reduced in a dose-dependent manner in modified oligonucleotide-treated cells. IC50 was calculated using the "log(inhibitor) vs. response–variable slope (4 parameters)" formula using Prism6 software.

Example 13: Activity of Modified Oligonucleotides Complementary to Human LRRK2 in Transgenic Mice, Two Week Assessment Modified oligonucleotides described above were tested in the human BAC wild type LRRK2 transgenic mouse model (B6; SJL-Tg(LRRK2)66Mjff/J; Stock No: 013725, The Jackson Laboratory) to assess activity after two weeks. Mice hemizygous for the BAC LRRK2-Wt transgene are viable and fertile. These mice express a wild-type human leucine-rich repeat kinase 2 (LRRK2) gene directed by the human LRRK2 promoter/enhancer regions on the BAC transgene (Ouyang Y et al., 2011). Mice from this model express human LRRK2 in a variety of tissues, including the spinal cord and brain.

Treatment

LRRK2 transgenic mice each received a single intracerebroventricular (ICV) dose of 300 µg of modified oligonucleotides listed in the table below. Each treatment group consisted of 4 mice. A group of 4 mice received PBS as a negative control.

RNA Analysis

After two weeks, mice were sacrificed and RNA was extracted from cortical brain tissue and spinal cord for real-time PCR analysis of measurement of RNA expression of LRRK2 using primer probe set hLRRK2 LTS35700 (described herein above in Example 11). Results are presented in the table below as percent LRRK2 RNA levels relative to relative to PBS control, normalized with cyclophilin A.

As shown in the table below, treatment with modified oligonucleotides resulted in reduction of human LRRK2 RNA in comparison to the PBS control.

TABLE 75

Reduction of human LRRK2 RNA in transgenic mice

| Compound Number | LRRK2 Expression (% control) | |
|---|---|---|
| | Cortex | Spinal Cord |
| PBS | 100 | 100 |
| 693430 | 46 | 37 |
| 725607 | 24 | 50 |
| 725608 | 19 | 33 |
| 725609 | 30 | 37 |
| 780162 | 59 | 76 |
| 780164 | 27 | 62 |
| 780166 | 14 | 26 |
| 780189 | 58 | 49 |
| 780202 | 42 | 36 |
| 780203 | 65 | 66 |
| 780205 | 13 | 29 |
| 780219 | 34 | 43 |
| 780236 | 19 | 29 |
| 780241 | 23 | 38 |
| 780243 | 54 | 47 |
| 780254 | 42 | 41 |
| 780284 | 61 | 53 |
| 780321 | 39 | 64 |
| 780347 | 42 | 51 |
| 780549 | 63 | 53 |
| 780602 | 93 | 103 |
| 780620 | 47 | 45 |
| 780624 | 63 | 75 |
| 780649 | 52 | 48 |
| 780685 | 42 | 37 |
| 802655 | 30 | 48 |
| 802678 | 7 | 26 |
| 802685 | 38 | 32 |
| 802686 | 17 | 40 |
| 802688 | 18 | 27 |
| 802689 | 16 | 36 |
| 802731 | 42 | 44 |
| 802746 | 42 | 64 |
| 802747 | 56 | 44 |
| 802748 | 32 | 25 |
| 802845 | 30 | 26 |
| 802846 | 35 | 41 |
| 802848 | 68 | 72 |

TABLE 76

Reduction of human LRRK2 RNA in transgenic mice

| Compound Number | LRRK2 Expression (% control) | |
|---|---|---|
| | Cortex | Spinal Cord |
| PBS | 100 | 100 |
| 802849 | 78 | 77 |
| 802850 | 73 | 92 |
| 802888 | 49 | 63 |
| 802911 | 80 | 92 |
| 802915 | 54 | 68 |
| 802935 | 69 | 61 |
| 802936 | 40 | 52 |
| 802937 | 43 | 40 |
| 802958 | 57 | 78 |
| 802960 | 54 | 48 |
| 802961 | 34 | 44 |
| 802962 | 40 | 51 |
| 802974 | 50 | 55 |
| 803002 | 30 | 44 |
| 803003 | 67 | 85 |
| 803004 | 73 | 86 |
| 803005 | 66 | 65 |
| 803046 | 95 | 65 |
| 803065 | 55 | 52 |
| 802959 | 41 | 62 |
| 803075 | 38 | 54 |
| 803102 | 89 | 89 |
| 803112 | 40 | 51 |
| 803122 | 52 | 71 |
| 803386 | 73 | 80 |
| 803515 | 81 | 104 |
| 803516 | 63 | 81 |
| 803517 | 55 | 67 |
| 803518 | 60 | 85 |
| 803519 | 70 | 79 |
| 803520 | 50 | 80 |
| 803571 | 66 | 71 |
| 803595 | 80 | 71 |
| 803604 | 65 | 67 |
| 803629 | 57 | 72 |
| 803682 | 47 | 46 |
| 803744 | 47 | 53 |
| 803770 | 73 | 54 |
| 803771 | 53 | 46 |
| 803773 | 40 | 50 |
| 803782 | 80 | 96 |

TABLE 77

Reduction of human LRRK2 RNA in transgenic mice

| Compound Number | LRRK2 Expression (% control) | |
|---|---|---|
| | Cortex | Spinal Cord |
| PBS | 100 | 100 |
| 780160 | 13 | 15 |
| 780161 | 24 | 30 |
| 802665 | 17 | 35 |
| 802678 | 27 | 35 |
| 802690 | 33 | 40 |
| 802714 | 21 | 47 |
| 802758 | 23 | 42 |
| 802770 | 11 | 22 |
| 802781 | 32 | 49 |
| 802784 | 16 | 30 |
| 802938 | 21 | 32 |
| 802939 | 13 | 41 |
| 802963 | 26 | 51 |
| 803000 | 22 | 42 |
| 803001 | 36 | 50 |
| 803006 | 29 | 39 |
| 803268 | 31 | 52 |
| 803269 | 38 | 49 |
| 803270 | 24 | 75 |
| 803271 | 31 | 48 |
| 803272 | 76 | 75 |
| 803273 | 77 | 70 |
| 803274 | 50 | 65 |

TABLE 78

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 24 | 19 |
| 803275 | 52 | 77 |
| 872246 | 44 | 49 |
| 872247 | 57 | 63 |
| 872248 | 24 | 44 |
| 872249 | 61 | 73 |
| 872250 | 34 | 28 |
| 872251 | 37 | 51 |
| 872252 | 54 | 62 |
| 872253 | 29 | 43 |
| 872254 | 94 | 71 |
| 872256 | 34 | 44 |
| 872257 | 70 | 72 |
| 872258 | 55 | 42 |
| 872259 | 82 | 72 |
| 872260 | 10 | 30 |
| 872261 | 37 | 55 |
| 872262 | 50 | 71 |
| 872263 | 28 | 49 |
| 872264 | 43 | 67 |
| 872265 | 36 | 35 |
| 872266 | 92 | 88 |
| 872267 | 68 | 74 |

TABLE 79

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 9 | 19 |
| 802780 | 42 | 49 |
| 802847 | 54 | 64 |
| 803021 | 67 | 70 |
| 803045 | 36 | 60 |
| 803064 | 42 | 67 |
| 803123 | 56 | 76 |
| 803181 | 41 | 74 |
| 803470 | 34 | 52 |
| 803503 | 67 | 72 |
| 803665 | 58 | 84 |
| 803769 | 71 | 90 |
| 872255 | 23 | 42 |
| 872268 | 52 | 66 |
| 872269 | 37 | 54 |
| 872270 | 39 | 61 |
| 872271 | 94 | 101 |
| 872272 | 76 | 77 |
| 872273 | 31 | 38 |
| 872274 | 54 | 85 |
| 872275 | 84 | 84 |
| 872276 | 73 | 97 |
| 872277 | 47 | 67 |
| 872278 | 36 | 68 |
| 872279 | 39 | 69 |
| 874144 | 81 | 86 |
| 874145 | 64 | 67 |
| 874146 | 67 | 64 |
| 874147 | 78 | 79 |
| 874148 | 57 | 58 |

TABLE 79-continued

Reduction of human LRRK2 RNA in transgenic mice

| Compound Number | LRRK2 Expression (% control) | |
|---|---|---|
| | Cortex | Spinal Cord |
| 874149 | 55 | 69 |
| 874150 | 57 | 44 |
| 874151 | 102 | 84 |

TABLE 80

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 30 | 41 |
| 803426 | 70 | 63 |
| 872280 | 83 | 64 |
| 872281 | 49 | 64 |
| 872282 | 48 | 64 |
| 872283 | 61 | 60 |
| 872285 | 26 | 41 |
| 876019 | 58 | 72 |
| 876097 | 47 | 46 |
| 876141 | 47 | 50 |
| 876168 | 103 | 89 |
| 876180 | 21 | 27 |
| 934558 | 54 | 49 |
| 934584 | 45 | 55 |
| 934585 | 162 | 95 |
| 934586 | 174 | 102 |
| 934587 | 35 | 238 |
| 934588 | 30 | 42 |
| 934589 | 19 | 30 |
| 934590 | 24 | 50 |
| 934591 | 42 | 52 |
| 934592 | 38 | 49 |
| 934593 | 31 | 35 |
| 934594 | 22 | 45 |
| 934595 | 59 | 61 |
| 934596 | n.d. | n.d. |
| 934597 | 48 | 59 |
| 934600 | 15 | 33 |

TABLE 81

Reduction of human LRRK2 RNA in transgenic mice

| Compound Number | LRRK2 Expression (% control) | |
|---|---|---|
| | Cortex | Spinal Cord |
| PBS | 100 | 100 |
| 780241 | 55 | 57 |
| 802678 | 12 | 20 |
| 876185 | 59 | 56 |
| 876190 | 25 | 38 |
| 876223 | 46 | 70 |
| 876326 | 36 | 57 |
| 876345 | 77 | 79 |
| 876735 | 64 | 57 |
| 876766 | 67 | 75 |
| 876900 | 41 | 46 |
| 877068 | 44 | 52 |
| 877159 | 52 | 61 |

TABLE 81-continued

Reduction of human LRRK2 RNA in transgenic mice

| Compound Number | LRRK2 Expression (% control) | |
|---|---|---|
| | Cortex | Spinal Cord |
| 877305 | 52 | 57 |
| 877328 | 68 | 76 |
| 890207 | 42 | 60 |
| 890208 | 32 | 45 |
| 890209 | 40 | 58 |
| 934599 | 29 | 37 |

TABLE 82

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 15 | 21 |
| 803427 | 34 | 32 |
| 876028 | 99 | 61 |
| 876029 | 106 | 69 |
| 876043 | 55 | 36 |
| 876062 | 39 | 26 |
| 876074 | 70 | 35 |
| 876146 | 82 | 42 |
| 876189 | 54 | 34 |
| 876203 | 90 | 46 |
| 876221 | 60 | 31 |
| 876237 | 80 | 35 |
| 876262 | 58 | 31 |
| 876284 | 74 | 41 |
| 876287 | 129 | 57 |
| 876302 | 81 | 34 |
| 876303 | 76 | 46 |
| 876899 | 60 | 34 |
| 876960 | 93 | 41 |
| 877119 | 62 | 36 |
| 877171 | 67 | 66 |
| 877292 | 68 | 58 |
| 877326 | 74 | 58 |
| 877349 | 106 | 81 |
| 877395 | 69 | 75 |

TABLE 83

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 13 | 13 |
| 876027 | 166 | 94 |
| 876031 | 23 | 18 |
| 876042 | 85 | 60 |
| 876068 | 80 | 54 |
| 876088 | 48 | 60 |
| 876143 | 79 | 70 |
| 876186 | 60 | 45 |
| 876195 | 54 | 48 |
| 876261 | 32 | 35 |
| 876263 | 46 | 42 |
| 876282 | 64 | 45 |

TABLE 83-continued

Reduction of human LRRK2 RNA in transgenic mice

| Compound Number | LRRK2 Expression (% control) | |
|---|---|---|
| | Cortex | Spinal Cord |
| 876285 | 89 | 59 |
| 876294 | 37 | 39 |
| 876301 | 51 | 55 |
| 876328 | 63 | 53 |
| 876604 | 26 | 22 |
| 876790 | 87 | 54 |
| 877098 | 65 | 41 |
| 877176 | 175 | 74 |

TABLE 84

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 31 | 40 |
| 872284 | 69 | 57 |
| 876274 | 65 | 60 |
| 877113 | 76 | 98 |
| 877303 | 67 | 68 |
| 890206 | 41 | 77 |
| 934538 | 49 | 49 |
| 934540 | 80 | 67 |
| 934541 | 43 | 54 |
| 934542 | 44 | 63 |
| 934543 | 58 | 60 |
| 934544 | 46 | 52 |
| 934545 | 39 | 35 |
| 934546 | 37 | 44 |
| 934547 | 45 | 51 |
| 934548 | 37 | 43 |
| 934549 | 34 | 42 |
| 934552 | 37 | 35 |
| 934553 | 27 | 36 |
| 934554 | 23 | 36 |
| 934555 | 38 | 43 |
| 934556 | 10 | 17 |
| 934557 | 17 | 29 |
| 934558 | 46 | 51 |

TABLE 85

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 10 | 17 |
| 934514 | 17 | 28 |
| 934515 | 16 | 21 |
| 934516 | 9 | 26 |
| 934517 | 16 | 36 |
| 934518 | 25 | 23 |
| 934519 | 71 | 70 |
| 934520 | 47 | 27 |
| 934521 | 52 | 50 |
| 934522 | 45 | 58 |
| 934523 | 29 | 30 |

TABLE 85-continued

Reduction of human LRRK2 RNA in transgenic mice

| Compound Number | LRRK2 Expression (% control) | |
|---|---|---|
| | Cortex | Spinal Cord |
| 934524 | 35 | 38 |
| 934525 | 50 | 56 |
| 934526 | 41 | 43 |
| 934528 | 28 | 33 |
| 934529 | 30 | 33 |
| 934530 | 31 | 35 |
| 934531 | 33 | 37 |
| 934532 | 33 | 37 |
| 934533 | 37 | 32 |
| 934534 | 38 | 44 |
| 934535 | 80 | 55 |
| 934536 | 57 | 61 |
| 934537 | 45 | 45 |

TABLE 86

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 11 | 22 |
| 952334 | 43 | 27 |
| 952335 | 86 | 96 |
| 952336 | 34 | 53 |
| 952338 | 68 | 62 |
| 952340 | 36 | 36 |
| 953599 | 123 | 87 |
| 953600 | 105 | 83 |
| 953601 | 103 | 87 |
| 953602 | 70 | 89 |
| 953603 | 48 | 74 |
| 953604 | 36 | 46 |
| 953605 | 69 | 51 |
| 953606 | 93 | 74 |
| 953607 | 53 | 65 |
| 953608 | 41 | 36 |
| 953609 | 84 | 69 |
| 953610 | 59 | 61 |
| 953611 | 42 | 61 |
| 953612 | 47 | 85 |
| 953613 | 81 | 74 |
| 953614 | 61 | 62 |
| 953615 | 41 | 42 |
| 953616 | 79 | 57 |
| 953617 | 107 | 67 |

TABLE 87

Reduction of human LRRK2 RNA in transgenic mice

| Compound Number | LRRK2 Expression (% control) | |
|---|---|---|
| | Cortex | Spinal Cord |
| PBS | 100 | 100 |
| 802678 | 16 | 18 |
| 952358 | 80 | 84 |
| 952359 | 54 | 66 |
| 952360 | 34 | 39 |
| 952361 | 51 | 47 |
| 952362 | 42 | 41 |
| 952363 | 45 | 42 |
| 952364 | 45 | 57 |
| 952365 | 39 | 63 |
| 952366 | 38 | 56 |
| 952367 | 61 | 50 |
| 952368 | 33 | 52 |
| 952369 | 56 | 59 |
| 952370 | 37 | 62 |
| 952371 | 34 | 56 |
| 952372 | 27 | 65 |
| 952373 | 43 | 55 |
| 952374 | 58 | 72 |
| 952375 | 20 | 42 |
| 952376 | 29 | 41 |
| 952377 | 20 | 34 |
| 952378 | 28 | 41 |
| 952379 | 35 | 49 |
| 952380 | 22 | 51 |
| 952381 | 22 | 40 |

Example 14: Activity of Modified Oligonucleotides Complementary to Human LRRK2 in Transgenic Mice, Eight Week Assessment Modified oligonucleotides described above were tested in the human BAC wild type LRRK2 transgenic mouse model (described herein above) to assess activity after eight weeks. Mice hemizygous for the BAC LRRK2-Wt transgene are viable and fertile. These mice express a wild-type human leucine-rich repeat kinase 2 (LRRK2) gene directed by the human LRRK2 promoter/enhancer regions on the BAC transgene (Ouyang Y et al., 2011). Mice from this model express human LRRK2 in a variety of tissues, including the spinal cord and brain.

Treatment

LRRK2 transgenic mice each received a single ICV dose of 300 µg of modified oligonucleotides listed in the table below. Each treatment group consisted of 4 mice. A group of 4 mice received PBS as a negative control.

RNA Analysis

After eight weeks, mice were sacrificed and RNA was extracted from cortical brain tissue and spinal cord for real-time PCR analysis of measurement of RNA expression of LRRK2 using primer probe set hLRRK2 LTS35700 (described herein above in Example 11). Results are presented in the table below as percent LRRK2 RNA levels relative to relative to PBS control, normalized with cyclophilin A.

As shown in the table below, treatment with modified oligonucleotides resulted in reduction of human LRRK2 RNA in comparison to the PBS control.

TABLE 88

Reduction of human LRRK2 RNA in transgenic mice

| Compound Number | LRRK2 Expression in Cortex (% control) |
|---|---|
| PBS | 100 |
| 802665 | 44 |
| 934556 | 16 |
| 934517 | 26 |
| 802678 | 19 |
| 876031 | 33 |
| 934553 | 34 |
| 934554 | 34 |
| 780166 | 28 |
| 802714 | 27 |
| 802770 | 16 |
| 802938 | 23 |
| 803270 | 33 |
| 780161 | 39 |
| 780241 | 44 |
| 934557 | 18 |

TABLE 89

Reduction of human LRRK2 RNA in transgenic mice

| Compound Number | LRRK2 Expression in Cortex (% control) |
|---|---|
| PBS | 100 |
| 780164 | 54 |
| 803000 | 39 |
| 803268 | 66 |
| 876604 | 78 |
| 934518 | 21 |

Example 15: Activity of Modified Oligonucleotides Complementary to Human LRRK2 in Transgenic Rats Modified oligonucleotides described above were tested in the human BAC G2019S mutant LRRK2 transgenic rat (NTac:SD-Tg(LRRK*G2019S)571Cjli; Taconic) model to assess activity. The model was created through pronuclear injection of the entire human LRRK2 gene with the G2019S mutation into NTac:SD zygotes. Rats from this model express human LRRK2 in a variety of tissues, including the spinal cord and brain (West A B et al., *J. Comp. Neurology*, 2014, 522(11):2465-2480).

Treatment

LRRK2 transgenic rats each received a single ICV dose of 1,000 μg of modified oligonucleotides listed in the table below. Each treatment group consisted of 4-5 rats. A group of 4 rats received PBS as a negative control.

RNA Analysis

After two weeks, rats were sacrificed and RNA was extracted from brainstem, cortical brain tissue, spinal cord, lung and kidney for real-time PCR analysis of measurement of RNA expression of LRRK2 using primer probe set hLRRK2 LTS35700 (described herein above in Example 11). Results are presented in the table below as percent LRRK2 RNA levels relative to relative to PBS control, normalized with cyclophilin A.

As shown in the table below, treatment with modified oligonucleotides resulted in reduction of human LRRK2 RNA in comparison to the PBS control.

TABLE 90

Reduction of human LRRK2 RNA in transgenic rats

| Compound Number | LRRK2 Expression (% control) | | |
|---|---|---|---|
| | Brainstem | Cortex | Spinal Cord |
| PBS | 100 | 100 | 100 |
| 780241 | 60 | 42 | 54 |
| 802714 | 43 | 33 | 53 |
| 803268 | 66 | 58 | 73 |
| 876031 | 33 | 9 | 33 |
| 876604 | 38 | 19 | 39 |
| 934556 | 31 | 9 | 35 |

Example 16: Potency of Modified Oligonucleotides Complementary to Human LRRK2 in Transgenic Rats Modified oligonucleotides described above were tested in the human BAC G2019S mutant LRRK2 transgenic rat (NTac:SD-Tg(LRRK*G2019S)571Cjli) model, described herein above, to test the potency of oligonucleotides.

Treatment

LRRK2 transgenic rats each received a single intracerebroventricular (ICV) dose of 10, 30, 100, 300, 700, 1,000, or 3,000 μg of modified oligonucleotides listed in the table below. Each treatment group consisted of 5 rats. A group of 5 rats received PBS as a negative control for each dosage group.

RNA Analysis

After two weeks, rats were sacrificed and RNA was extracted from cortex for real-time PCR analysis of measurement of RNA expression of LRRK2 using primer probe set hLRRK2 LTS35700 (described herein above in Example 11). Results are presented in the table below as percent LRRK2 RNA levels relative to relative to PBS control, normalized with cyclophilin A.

As shown in the table below, treatment with modified oligonucleotides resulted in reduction of human LRRK2 RNA in comparison to the PBS control. Dose response data was analyzed using GraphPad Prism 6 software (San Diego, CA). $ED_{50}$ values were calculated from log transformed dose or concentrations and individual animal LRRK2 RNA levels using the built in GraphPad formula "log(agonist) vs. response–Find ECanything", with the following constraints: bottom >0, top=100, F=50 for $ED_{50}$

TABLE 91

Dose-dependent percent reduction of human LRRK2 RNA in transgenic rats, cortex

| Compound Number | LRRK2 expression (% control) in cortex | | | | | | $ED_{50}$ (μg/g) |
|---|---|---|---|---|---|---|---|
| | 10 μg | 30 μg | 100 μg | 300 μg | 1000 μg | 3000 μg | |
| 780241 | 107.4 | 96.4 | 75.9 | 41.9 | 33.1 | 34.9 | 129 |
| 876031 | 102.0 | 94.6 | 67.6 | 18.7 | 5.9 | 4.6 | 135 |
| 934556 | 105.9 | 94.2 | 56.6 | 17.3 | 7.1 | 3.7 | 111 |

Example 17: Tolerability of Modified Oligonucleotides Complementary to LRRK2 in Wild-Type Mice, 3 Hour FOB Assessment Modified oligonucleotides described above were tested in wild-type female C57/Bl6 mice to assess the tolerability of the oligonucleotides. Wild-type female C57/B16 mice each received a single ICV dose of 700 μg of modified oligonucleotide listed in the table below. Each treatment group consisted of 4 mice. A group of 4 mice received PBS as a negative control for each experiment (identified in separate tables below). At 3 hours post-injection, mice were evaluated according to seven different criteria. The criteria are (1) the mouse was bright, alert, and responsive; (2) the mouse was standing or hunched without stimuli; (3) the mouse showed any movement without stimuli; (4) the mouse demonstrated forward movement after it was lifted; (5) the mouse demonstrated any movement after it was lifted; (6) the mouse responded to tail pinching; (7) regular breathing. For each of the 7 criteria, a mouse was given a subscore of 0 if it met the criteria and 1 if it did not (the functional observational battery score or FOB). After all 7 criteria were evaluated, the scores were summed for each mouse and averaged within each treatment group. The results are presented in the tables below.

TABLE 92

Tolerability scores in mice at 700 μg dose

| Compound Number | 3 hr FOB |
|---|---|
| PBS | 0 |
| 802678 | 0 |
| 693430 | 0 |
| 725607 | 0 |
| 780164 | 0 |
| 780166 | 6 |
| 780205 | 0 |
| 780254 | 7 |
| 780321 | 0 |
| 780685 | 2 |
| 802685 | 0 |
| 802688 | 0 |
| 802689 | 0 |
| 802731 | 6 |
| 802746 | 6 |
| 802888 | 6 |
| 802936 | 4 |
| 802937 | 4 |
| 802959 | 1 |
| 802962 | 0 |
| 802974 | 0 |
| 803002 | 7 |
| 803075 | 4 |
| 803682 | 1 |

TABLE 93

Tolerability scores in mice at 700 μg dose

| Compound Number | 3 hr FOB |
|---|---|
| PBS | 0 |
| 780160 | 0 |
| 802784 | 6 |
| 802939 | 3 |
| 803006 | 5 |
| 872248 | 7 |
| 872253 | 7 |
| 872260 | 7 |
| 872263 | 7 |
| 876190 | 2 |
| 934552 | 2 |
| 934553 | 0 |
| 934554 | 2 |
| 934555 | 2 |

TABLE 93-continued

Tolerability scores in mice at 700 μg dose

| Compound Number | 3 hr FOB |
|---|---|
| 934556 | 1 |
| 934557 | 1 |

TABLE 94

Tolerability scores in mice at 700 μg dose

| Compound Number | 3 hr FOB |
|---|---|
| PBS | 0 |
| 872255 | 5 |
| 934514 | 4 |
| 934515 | 2 |
| 934516 | 6 |
| 934518 | 4 |
| 934523 | 7 |
| 934528 | 5 |
| 934529 | 5 |
| 934530 | 3 |
| 934517 | 4 |
| 802758 | 7 |
| 876180 | 0 |

TABLE 95

Tolerability scores in mice at 700 μg dose

| Compound Number | 3 hr FOB |
|---|---|
| PBS | 0 |
| 780161 | 1 |
| 780164 | 5 |
| 780166 | 6 |
| 802665 | 1 |
| 802714 | 3 |
| 802770 | 4 |
| 802938 | 4 |
| 802963 | 0 |
| 803000 | 4 |
| 803268 | 4 |
| 803270 | 1 |

TABLE 96

Tolerability scores in mice at 700 μg dose

| Compound Number | 3 hr FOB |
|---|---|
| PBS | 0 |
| 876031 | 0 |
| 876604 | 5 |

TABLE 97

Tolerability scores in mice at 700 μg dose

| Compound Number | 3 hr FOB |
|---|---|
| PBS | 0 |
| 952334 | 2 |
| 952335 | 0 |
| 952336 | 2 |

TABLE 97-continued

Tolerability scores in mice at 700 µg dose

| Compound Number | 3 hr FOB |
|---|---|
| 952338 | 5 |
| 952340 | 3 |
| 952358 | 5 |
| 952359 | 7 |
| 952360 | 6 |
| 952361 | 4 |
| 952362 | 6 |
| 952363 | 3 |

TABLE 98

Tolerability scores in mice at 700 µg dose

| Compound Number | 3 hr FOB |
|---|---|
| PBS | 0 |
| 952364 | 0 |
| 952365 | 0 |
| 952366 | 3 |
| 952367 | 6 |
| 952368 | 5 |
| 952369 | 7 |
| 952370 | 7 |
| 952371 | 6 |
| 952372 | 7 |
| 952373 | 7 |
| 952374 | 4 |
| 952375 | 2 |
| 952376 | 5 |
| 952377 | 6 |
| 952378 | 3 |
| 952379 | 4 |
| 952380 | 7 |
| 952381 | 6 |
| 953599 | 0 |
| 953600 | 0 |
| 953601 | 0 |
| 953602 | 0 |
| 953603 | 0 |
| 953604 | 4 |
| 953605 | 5 |
| 953606 | 6 |
| 953607 | 3 |
| 953608 | 6 |
| 953609 | 6 |
| 953610 | 3 |
| 953611 | 3 |
| 953612 | 1 |
| 953613 | 0 |
| 953614 | 2 |
| 953615 | 4 |
| 953616 | 5 |
| 953617 | 5 |

Example 18: Tolerability of Modified Oligonucleotides Complementary to Human LRRK2 in Rats, 3 Hour FOB Assessment Modified oligonucleotides described abovere were tested in Sprague Dawley rats to assess the tolerability of the oligonucleotides. Sprague Dawley rats each received a single intrathecal (IT) dose of 3 mg of oligonucleotide listed in the table below. Each treatment group consisted of 3-4 rats. A group of 4 rats received PBS as a negative control for each experiment (identified in separate tables below). At 3 hours post-injection, movement of 7 different parts of the body was evaluated for each rat. The 7 body parts are (1) the rat's tail; (2) the rat's posterior posture; (3) the rat's hind limbs; (4) the rat's hind paws; (5) the rat's forepaws; (6) the rat's anterior posture; (7) the rat's head. For each of the 7 different body parts, each rat was given a sub-score of 0 if the body part was moving or 1 if the body part was not moving. For each of the 7 criteria, a rat was given a subscore of 0 if it met the criteria and 1 if it did not (the functional observational battery score or FOB). After all 7 criteria were evaluated, the scores were summed for each rat and averaged within each treatment group. The results are presented in the tables below.

TABLE 99

Tolerability scores in rats at 3 mg dose

| Compound Number | 3 hr FOB |
|---|---|
| PBS | n.d. |
| 780164 | 2 |
| 780166 | 2 |
| 780189 | 1 |
| 780236 | 4 |
| 780241 | 1 |
| 780243 | 3 |
| 780254 | 3 |
| 780347 | 0 |
| 780549 | 0 |

TABLE 100

Tolerability scores in rats at 3 mg dose

| Compound Number | 3 hr FOB |
|---|---|
| PBS | 0.25 |
| 780236 | 5 |
| 802678 | 2 |
| 802688 | 2 |
| 802748 | 6 |
| 872259 | 3 |
| 872261 | 4 |
| 872269 | 4 |
| 872279 | 3 |

TABLE 101

Tolerability scores in rats at 3 mg dose

| Compound Number | 3 hr FOB |
|---|---|
| PBS | 0 |
| 725607 | 1 |
| 780620 | 6 |
| 802888 | 5 |
| 802936 | 5 |
| 802937 | 5 |
| 802959 | 4 |
| 802961 | 2 |
| 802962 | 2 |
| 802974 | 3 |
| 803520 | 5 |

TABLE 102

Tolerability scores in rats at 3 mg dose

| Compound Number | 3 hr FOB |
|---|---|
| PBS | 0 |
| 725609 | 0 |
| 780164 | 3 |
| 780166 | 6 |
| 780205 | 3 |
| 802689 | 2 |
| 802731 | 7 |
| 802746 | 5 |
| 802845 | 2 |
| 802846 | 4 |
| 876088 | 1 |

TABLE 103

Tolerability scores in rats at 3 mg dose

| Compound Number | 3 hr FOB |
|---|---|
| PBS | 0 |
| 802655 | 5 |
| 802686 | 2 |
| 802688 | 2 |
| 803075 | 5 |
| 803682 | 1 |
| 876031 | 0 |
| 876261 | 4 |
| 876263 | 2 |
| 876294 | 2 |

TABLE 104

Tolerability scores in rats at 3 mg dose

| Compound Number | 3 hr FOB |
|---|---|
| PBS | 0 |
| 693430 | 3 |
| 780219 | 5 |
| 780254 | 2 |
| 780321 | 3 |
| 780347 | 1 |

TABLE 105

Tolerability scoes in rats at 3 mg dose

| Compound Number | 3 hr FOB |
|---|---|
| PBS | 0 |
| 780160 | 1 |
| 780161 | 2 |
| 802784 | 5 |
| 802938 | 1 |
| 802939 | 3 |
| 802963 | 2 |
| 803000 | 5 |
| 803006 | 4 |
| 803270 | 1 |
| 872248 | 3 |
| 872253 | 6 |

TABLE 106

Tolerability scores in rats at 3 mg dose

| Compound Number | 3 hr FOB |
|---|---|
| PBS | 0 |
| 872260 | 5 |
| 872263 | 7 |
| 934553 | 0 |
| 934554 | 0 |
| 934555 | 2 |
| 934556 | 0 |
| 934557 | 0 |

TABLE 107

Tolerability scores in rats at 3 mg dose

| Compound Number | 3 hr FOB |
|---|---|
| PBS | 0 |
| 934517 | 2 |
| 934523 | 6 |
| 934528 | 4 |
| 934529 | 1 |
| 934530 | 0 |

TABLE 108

Tolerability scores in rats at 3 mg dose

| Compound Number | 3 hr FOB |
|---|---|
| PBS | 0 |
| 802678 | 0.5 |
| 802758 | 3.25 |
| 876604 | 5 |

TABLE 109

Tolerability scores in rats at 3 mg dose

| Compound Number | 3 hr FOB |
|---|---|
| PBS | 0 |
| 802665 | 1 |
| 802714 | 2 |
| 802770 | 2 |
| 803268 | 3 |
| 872255 | 5 |
| 934516 | 3 |
| 934518 | 4 |

TABLE 110

Tolerability scores in rats at 3 mg dose

| Compound Number | 3 hr FOB |
|---|---|
| PBS | 0 |
| 693421 | 2.5 |
| 690093 | 3.0 |

TABLE 111

Tolerability scores in rats at 3 mg dose

| Compound Number | 3 hr FOB |
|---|---|
| PBS | 0 |
| 952334 | 4 |
| 952335 | 2 |
| 952336 | 3 |
| 952338 | 2 |
| 952358 | 3 |
| 952359 | 2 |

TABLE 112

Tolerability scores in rats at 3 mg dose

| Compound Number | 3 hr FOB |
|---|---|
| PBS | 0 |
| 952378 | 5 |
| 952379 | 5 |
| 952380 | 3 |
| 952381 | 4 |
| 953599 | 1 |
| 953600 | 1 |
| 953601 | 0 |
| 953602 | 2 |
| 953603 | 0 |
| 953604 | 3 |
| 953605 | 5 |
| 953606 | 5 |

TABLE 113

Tolerability scores in rats at 3 mg dose

| Compound Number | 3 hr FOB |
|---|---|
| PBS | 0 |
| 953607 | 3 |
| 953608 | 4 |
| 953609 | 5 |
| 953610 | 3 |
| 953611 | 4 |
| 953612 | 3 |
| 953613 | 1 |
| 953614 | 4 |
| 953615 | 1 |
| 953616 | 4 |
| 953617 | 4 |

TABLE 114

Tolerability scores in rats at 3 mg dose

| Compound Number | 3 hr FOB |
|---|---|
| PBS | 0 |
| 952371 | 4 |
| 952372 | 4 |
| 952373 | 4 |
| 952374 | 2 |
| 952375 | 5 |
| 952376 | 4 |
| 952377 | 5 |

TABLE 115

Tolerability scores in rats at 3 mg dose

| Compound Number | 3 hr FOB |
|---|---|
| PBS | 0 |
| 952340 | 1 |
| 952360 | 4 |
| 952361 | 3 |
| 952362 | 5 |
| 952363 | 4 |
| 952364 | 5 |
| 952365 | 2 |
| 952366 | 5 |
| 952367 | 5 |
| 952368 | 6 |
| 952369 | 4 |
| 952370 | 5 |

Example 19: Prophylactic Reduction of LRRK2 with Modified Oligonucleotides in PFF Model Wild type mice received a single ICV injection of 700 µg of an oligonucleotide listed in the table below or PBS vehicle alone. Each treatment group consisted of eleven or twelve mice. Two weeks after oligonucleotide treatment, preformed fibrils (PFFs) of α-synuclein were injected into the striatum, resulting in formation of α-synuclein aggregates in several brain regions and motor deficits, as described (see Luk et al., Science, 2012, 338, 949-953). One control group did not receive injection of PFFs. Fifty-five days after the oligonucleotide treatment, motor function was tested in a wire hang test. The results are presented in the table below as the average length of time the mice of each treatment group remained on the wire.

One day after the wire hang test, all of the mice in each treatment group were sacrificed except for the group that received no oligonucleotide and no PFF injection; only four mice in that group were sacrificed. Animals were perfused with ice-cold PBS. Ipsilateral hemispheres were fixed and processed for immunochemistry. Contralateral midbrain and striatum were dissected and frozen until RNA analysis, while entire contralateral cortex was dissected and frozen until protein analysis. LRRK2 RNA expression was analyzed by quantitative real-time PCR using the murine primer probe set RTS3043 (forward sequence GGCGAGT-TATCCGCACCAT, designated herein as SEQ ID NO: 23; reverse sequence CCAAAACCAGCATGACATTCTTAA, designated herein as SEQ ID NO: 24; probe sequence TGAGAGCCATGGCCACAGCACAA, designated herein as SEQ ID NO: 25). LRRK2 RNA levels were adjusted according to total RNA content, as measured by RIBOGREEN. The results are shown in the table below as average percent inhibition relative to the wild type control group that received neither oligonucleotide treatment nor PFF injection.

LRRK2, α-synuclein, and hyperphosphorylated α-synuclein (p-α-syn) protein levels in the cortex were analyzed by western blot. Contralateral cortex tissue was first homogenized in RIPA buffer and centrifuged at 13,300×g. The supernatant was subjected to western blot for LRRK2 protein level, and β-tubulin was used as a loading control. The results indicated that LRRK2 protein levels in the cortex were significantly lower in the oligonucleotide treated animals than in the animals that did not receive oligonucleotide treatment. The pellet was resuspended in RIPA buffer, centrifuged at 100,000×g, and the resulting insoluble material was further suspended in 2% SDS buffer, followed by an additional 100,000×g spin. The resulting supernatant was analyzed by western blot for α-synuclein and p-α-syn. The results showed that PFF injection resulted in recruitment of endogenous mouse α-synuclein into insoluble aggregates, as reported in Luk et al. The aggregates were also hyperphosphorylated. Oligonucleotide treatments reduced formation of the aggregates, as evidenced by a reduction of insoluble mouse α-synuclein and p-α-syn in the western blots. p-α-syn aggregates in the substantia nigra were visualized by immunohistochemistry. The average number of aggregates observed for samples of equal size from each treatment group is shown in the table below. One-way ANOVA test of the results showed that the differences between the PBS treated and oligonucleotide treated animals were significant.

TABLE 116

Prophylactic treatment of PFF mice with LRKK2 modified oligonucleotides

| Compound Number | PFF injected | Time in wirehang test (sec) | Inhibition of LRRK2 RNA (%) | | No. of p-α-syn aggregates |
|---|---|---|---|---|---|
| | | | Midbrain | Striatum | |
| PBS | No | 193 | 0 | 4.0 | 0 |
| PBS | Yes | 94 | 0 | 0 | 42 |
| 693421 | Yes | 187 | 52.0 | 49.0 | 12 |
| 690093 | Yes | 175 | 43.0 | 24.8 | 21 |

Example 20: Reduction of LRRK2 with Modified Oligonucleotide in PFF Model

The effects of oligonucleotide reduction in wild type mice after the injection of PFFs was evaluated using 690093. Mice were treated as described in Example 19 except that oligonucleotide treatment occurred two weeks after PFF injection instead of two weeks before PFF injection. Each treatment group consisted of ten animals. Fifty-five days after PFF injection, the mice were assessed in a wire hang test, as described in Example 19. One day after the wire hang test, the mice were sacrificed, the midbrain, striatum, and substantia nigra were collected, and LRRK2 RNA and p-α-syn aggregates were measured, as described in Example 19. The results are shown in the table below as the averages for each treatment group. An entry of "nd" indicates that data was not collected for that treatment group. The results show that even when the modified oligonucleotide was administered after the onset of the PFF model, motor function was improved and the number of pathological aggregates was reduced.

TABLE 117

Treatment of PFF mice with LRKK2 modified oligonucleotides

| Oligo ID | PFF injected | Time in wirehang test (sec) | Inhibition of LRRK2 RNA (%) | | No. of p-α-syn aggregates |
|---|---|---|---|---|---|
| | | | Midbrain | Striatum | |
| PBS | No | 227 | 0 | 0 | nd |
| PBS | Yes | 58 | 0 | 0 | 49 |
| 690093 | Yes | 141 | 62.3 | 43.6 | 38 |

Example 21: Prophylactic Reduction of LRRK2 with Modified Oligonucleotides in PFF Model in a Long Term Study Modified oligonucleotides were tested in a long term study to determine if long term treatment with modified oligonucleotides is protective of dopaminergic neurons. Accumulation of α-syn aggregates in the substantia nigra pars compacta compromises survival of dopaminergic neurons over time (Luk 2012, Tran 2014).

The effects of oligonucleotide reduction in wild type mice after the injection of PFFs was evaluated using 690093 or control oligonucleotide 676630, a 5-10-5 MOE gapmer with mixed phosphodiester and phosphorothioate backbone with no known target. Mice were treated as described in Example 19 except mice received a second ICV dose of 690093 at 90 days, and were sacrificed at 180 days post first ICV treatment. Each treatment group consisted of 12 animals. At sacrifice, midbrain, striatum, and substantia nigra were collected, and LRRK2 RNA and p-α-syn aggregates were measured, as described in Example 19, and dopaminergic cells were quantified by immunohistochemistry using anti-tyrosine hydroxylase (TH) antibody. The results are shown in the table below as the averages for each treatment group. The results show that in the group treated with modified oligonucleotide complementary to LRRK2, the number of pathological aggregates was reduced over a long treatment course. Additionally, quantification of TH-positive neurons showed that 690093-mediated LRRK2 suppression rescued TH-positive cells in the ipsilateral substantia nigra pars compacta as compared to control treated cells.

TABLE 118

Prophylactic treatment of PFF mice with LRKK2 modified oligonucleotides in long term study

| Compound Number | PFF injected | Inhibition of LRRK2 RNA (%) | | No. of p-α-syn aggregates | No. of dopaminergic cells |
|---|---|---|---|---|---|
| | | Midbrain | Striatum | | |
| 676630 | Yes | 0 | 0 | 160 | 5880 |
| 690093 | Yes | 61.7 | 0 | 48 | 7522 |

Example 22: Tolerability of Modified Oligonucleotides Complementary to Human LRRK2 in Rats, Long-Term Assessment In separate studies run under the same conditions, modified oligonucleotides described above were tested in Sprague Dawley rats to assess the long-term tolerability of the oligonucleotides. Sprague Dawley rats each received a single intrathecal (IT) delivered dose of 3 mg of oligonucleotide or PBS. For 6 weeks beginning 1 week post-treatment, each animal was weighed and evaluated weekly by a trained observer for adverse events. Adverse events were defined as neurological dysfunction not typical in PBS-treated control animals, including, but not limited to: abnormal limb splay, abnormal gait, tremors, abnormal respiration, paralysis, and spasticity. The onset of the adverse event is defined as the week post-dosing when the dysfunction was first recorded. If no adverse event was achieved, there is no onset (–). The onset of adverse events typically correlates with a failure to thrive as defined by a lack of body weight gain/maintenance similar to PBS-treated animals. Similar tolerability assessments were described in Ostergaard et al., Nucleic Acids Res. 2013 November; 41(21): 9634-9650 and Southwell et al., Mol Ther. 2014 December; 22(12): 2093-2106. As shown in the table below, 876031, 780241, 802714, 803268, 876604, and 934556 were well-tolerated in the long-term tolerability assessment.

TABLE 119

Long-term tolerability in rats at 3 mg dose

| Compound Number | Adverse event onset, weeks post-treatment, individual animals |
|---|---|
| 690093 | 2, 3, 4, 4 |
| 693421 | 4, -, -, - |

TABLE 119-continued

Long-term tolerability in rats at 3 mg dose

| Compound Number | Adverse event onset, weeks post-treatment, individual animals |
|---|---|
| 876031 | -, -, -, - |
| 780241 | -, -, -, - |
| 802714 | -, -, -, - |
| 803268 | -, -, -, - |
| 876604 | -, -, -, - |
| 934556 | -, -, -, - |
| PBS | -, -, -, - |

SEQUENCE LISTING (4010 sequences)

SEQ ID NO: 1 - RNA, 9239 nt, Homo sapiens
  source 1..9239: mol_type = mRNA
gcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcacgcctccaagttatttcaaggcaaaaatatccatgtgcctctgttgatcgtcttggactcctatatgagagtcgcgagtgtgcagcaggtgggttggtcacttctgtgcaaattaatagaagtctgtccaggtacaatgcaaagcttaatgggaccccaggatgttggaaatgattgggaagtccttggtgttcaccaattgattcttaaaatgctaacagttcataatgccagtgtaaacttgtcagtgattggactgaagaccttagatctcctcctaacttcaggtaaaatcaccttgctgatattggatgaagaaagtgatattttcatgttaatttttgatgccatgcactcatttccagccaatgatgaagtccagaaacttggatgcaaagctttacatgtgctgtttgagagagtctcagaggagcaactgactgaatttgttgagaacaaagattatatgatattgttaagtgcgttaacaaattttaaagatgaagaggaaattgtgcttcatgtgctgcattgtttacattccctagcgattccttgcaataatgtggaagtcctcatgagtggcaatgtcaggtgttataatattgtggtggaagctatgaaagcattccctatgagtgaaagaattcaagaagtgagttgctgtttgctccataggcttacattaggtaattttttcaatatcctggtattaaacgaagtccatgagtttgtggtgaaagctgtgcagcagtacccagagaatgcagcattgcagatctcagcgctcagctgtttggccctcctcactgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggaggccgcatgctgggcactaaataatctccttatgtaccaaaacagtttacatgagaagattggagatgaagatggccatttcccagctcatagggaagtgatgctctccatgctgatgcattcttcatcaaaggaagttttccaggcatctgcgaatgcattgtcaactctcttagaacaaaatgttaatttcagaaaaatactgttatcaaaaggaatacacctgaatgttttggagttaatgcagaagcatatacattctcctgaagtggctgaaagtggctgtaaaatgctaaatcatctttttgaaggaagcaacacttccctggatataatggcagcagtggtccccaaaatactaacagttatgaaacgtcatgagacatcattaccagtgcagctggaggcgcttcgagctattttacattttatagtgcctggcatgccagaagaatccagggaggatacagaatttcatcataagctaaatatggttaaaaaacagtgtttcaagaatgatattcacaaactggtcctagcagctttgaacaggttcattggaaatcctgggattcagaaatgtggattaaaagtaatttcttctattgtacattttcctgatgcattagagatgttatccctggaaggtgctatggattcagtgcttcacacactgcagatgtatccagatgaccaagaaattcagtgtctgggtttaagtcttataggatacttgattacaaagaagaatgtgttcataggaactggacatctgctggcaaaaattctggtttccagcttataccgatttaaggatgttgctgaaatacagactaaaggatttcagacaatcttagcaatcctcaaattgtcagcatctttttctaagctgctggtgcatcattcatttgacttagtaatattccatcaaatgtcttccaatatcatggaacaaaaggatcaacagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaaatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggaagtgaaggctcatttcttgtgaaaaagaaatctaattcaattagtgtaggagaattttaccgagatgccgtattacagcgttgctcaccaaatttgcaaagacattccaattccttggggcccatttttgatcatgaagatttactgaagcgaaaaagaaaaatattatcttcagatgattcactcaggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaaactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttgctgctatgcctttcttgcctccttctatgacaatcctaaaattatctcagaacaaattttcctgtattccagaagcaattttaaatcttccacacttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtcgtgaggaattctatagtactcatccccattttatgacgcagcgagcattgtaccttgctgtctatgacctcagcaagggacaggctgaagttgatgccatgaagccttggctcttcaatataaaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctttgtaaaatcatggcacagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtgatggcagttttggatcagtttaccgagcagcctatgaaggagaagaagtggctgtgaagatttttaataaacatacatcactcaggctgttaagacaagagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctgatccagttaaagaatatggttgtgccccatggcctatggttgagaaattaattaaacagtgtttgaaagaaaatcctcaagaaaggcctacttctgcccaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaaggtacacaaaagcagaaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaaaaaaaaaaaaaaaaa

SEQ ID NO: 2 - DNA, 150001 bp, Homo sapiens
  source 1..150001: mol_type = genomic DNA
gtactttttccttcttcagaaattgatagagaaaggctactacatactctgaatggatgtcaattggacatccaaaaggacaagatggcaattctcccatcttgtccttcttcaaaagtgtctagtctatactaggccttttgatcttgctgaaatctatgtaaatcttgttgagaatttcactaatcttgcattgttttttattactttgtagagaattgacatatttttgaatttagttttcccattaattaatgtgatattaatatttattcatgcctttttaatgccttttaacagagttcaataatttattcataaaggttttgtaaatatttgttaatttattttcaaggtttccctttcattgtcatcatacacacacacacacacaattgcactttatgcttgtgcatcactcatgtttaggaacacattttttttataatgatgacattaaaaaatacttattggtcattcaaaatgaatttccttttcaaaaccttagtttattattttttttcctggtctatctgtggcgtaataccctcctcccagtgatttgtaagaacttttgaaagttgaaggcaaattgtatttcatcatatgtatttcaaattttttcttcctgtttgccgtttgacttctagtttcattattgggtattttttctttgactgcagaaaatttaaatttgatggagtcacatatactacccttatgtgatttcttttttgtttttatgtttcctttttcaagattatataactattaatttatattttatttttgaagttatttttatttaactttttaatctatttgatgtttgctgtaattagtaatgtcagttttattttttttcttttcaggaaattagccaaatgttctagcaccattttattctccactgaaccctgcttccatcataaattcatgccttaatcttcattttcagtcttgttaactacttgaagagttgataaatcttggaatttcagtcaatcaattaaacatttttgaaaactaagagaatactttaccttaacactgcagtagttcatgggagaatgctcccaacaaataattcatattttcacactgtctactcacagtctggccaatatagagtagataataaataggcaatagatggatgaatgaattgtggaaattaggagacatcttttaatttagatttatttttctttggaagggaggtaggttttaatttcttgcaaggttgtaattcagtagaacaggaagggagaaactaatgcagaggaacagaaggaatgcatgagatggagaatgcctagaaatgtttgagacattgattaagtcatcagaaatggaaacaagtttagaaacaacttagaaaataatacactgtaggtctgataaatattgtaagattgggagttttttgttaaattatggaaaattttatatagatacaatagtagaacagaccacatgaacccatctcatattatcttcaacaattatcaattcaaaagttgttatcgttatctctatctccacacatttcatcttttcctccaccactggatgactttgaaagaaatcctaaccatttcaactataaatattttagcatgtctctgtaaaagttaaagactctataacaacaagacatagacccaatatccaggttgagtaggagtttgctatcttactaatctaatgtattaacaaagtctagagcattcttattaaagtggtagagcatgaagaaccttctacctggagttaggagatttgctgggttgaagtcctggctctcaacttcccacctgtgtgactccagcaaagctcttcacttctcaattccaaatctcaatttcctcactagtgaaagaaggatacatagtagtagttgtatccatttcagaattgtcatcaggattgaagtaacagatgtgaaaacaaaactaaaattgtgaagtagtaacttccagtccaatcctcttctttgtaagtgatcttgaggacagacacatcacctgaaggatagatcatctttgcctagccttgtctacaatgttcttgctaggtttcttttcctaaaaacacattacttaggtacttaacagaacaaacaaacaaacaatcaaaagacaaaaccaaaaaactttggggttatagacacccatactcataagtatttctgaataccaagagaagagtatttaggtttgcttctctcaacttttcacctttcatttcatgtaccctgtcctttgtctcagctctaatagctctgagagctgattacttttcgggtgtcccaagtatcaggatcctgcctagtgcaactcaaatttccaaaagttaatttagtggccttttggtgaccagagcttcagataactcacagggaaacaatgtttatttcctctcccactaacagtcacaaaaaatcataaaaaagagtagcgggggcagttttgatggctaacccctctttccatcctttgggggaaaattgctcatctccctataggtggaactctaaagacaatgtattcctaaaaggggccatctgggcggtgtcctcttttcccagcgccctgatttctattcttagatctggagataggcggctttcatttttcctgctcccagttcccagaccttccgtggggccgcaggatccccggctggcgggtcgcggagggtggccggccgggctgcgcactgcgcgcctccgctgcggggctccgggcctgtggactcagcggagtccgctgagtcagtttcttcccgcgcgactcccggccgcgccgccgctgcggtggaatctggtcccaggaggcggcgtccgcccggggtccggtctaggcgtgcgtgggggccacggtcacggtcatcccagccaggcccggctccagcagccccacggccgccgccagagttctgcgcggcccgtcgcctcggcggagcctctggcaggcccctgagctcgtttttggggcctgagtgggggaggaggaagccgagcaggagggctccggagagggagggcaacgcggggcggggagctgcctccttcctcataaacaggcgggcgtgggcgccgatggggcccgcggggagcgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcgcggtaatcacttgaaaataaactgtgcttttatttttgcaaactttctccccctccttacatttgcaaattttgtcctcctccccttgaccctgctcaaacccggactcttaaggagccgcaaactcccatatcctttccttagggcagaaagcagctgagaatttcaggaaggtcttcacctttttgacttttctccccgtttcagactaaaaaggagagggggtgctgtggattgtgactttgcttcttttccccacccacttgttttccagcctccaagttatttcaaggcaaaaatatccatgtgcctctgttgatcgtcttggactcctatatgagagtcgcgagtgtgcagcaggtaaaggcattgttttcacttcaactcattctcccttctgtttggaaggagacgttttactggcaatgttaatatagccgagagttcttggttattcccaaaatttggcttgaggaacctctgactgtgattttaagatgggaatattgttaaatcattacgcaatgtaaacgggatgaagagccccagtatgtgttccctgagtgtctttaagaagtaactttataaaaccaacagtatggatggtggtagaaggaggataaaaatgggttcggttttagtctcgttattggcaagatgaattcattagtgtttagacttgactattccaagtatcttcccaatacagagcatgtcctagatgagaagattatgaatagtttggaaaaggggaataattaatagtgataaaatgcaactttgtcactagcaaactcttgtagagttcagcactttttaaaattcaaagatttctagcctttagttgtagtataccttgtagtatctaaagaaagtgatgtcttatgagaccctcatagtttgcaactgttgtcatataaaatgcatgtagaagtgaaacttttacaatctgtaccataggaaacccagaaatttgctatgtatcttggatttttttttaaagggggccttaaaaatggtaattaagaatgatttacagtcaaaacaaaattataggccaaggtgataacttccttcggagcacttagagatttggggaactgaaatcagttttgtcatctgcatgttaactcatgcagagaaagagaattggactttgaactccttggaggtgcagtcagaaagccaatgtttcttaatggttgagaggcttgacagacatgaggcatctcaatctttaaagtggtgtgggtctatctttatcttgatgtttatctctgtatctagctgtatctagtctgggtgaaccatctagcttctttgatatgaggacatttacatctggaagaaatattttaatttgttttcaactgtgaaatattttccatctgactattatagattttcacgctgctatcaaaccaaaccaagaaaagatggaggcataataaagatgctgttcttttaagactcaaagtcggaattttgcctgtggaatatgagtcactttttgggcactggcctattgtgcttcctgctctgcacccacgtcatcccttcttacttgtctctgctttggtgttcagaagtgcctgattctggccaccttcattccctagactctgtacttgatagagtcactcctgcttgatactgctcaggacagtcagatcctgggtaggcgttttggtctgcagggtctagataaggcagtgctatacttgacaacccaggggagcctggaacatacttcctaattcttaattttagaaattgcccaagcctgagcatacttgtccggagtagttatgagtgtcacttagtatttctgcctagagagtaccagaggcaaagtatgctggaaaataaggaagagtttttttaaaagtaattaattacttttttggatatatcatagttgtatatattttggggatacatatgctatttgatacatgtatacaatgtgtaatgttcaaatcagggtaactggaatatccgtcacctcgaacatttttctttgtgttggcaacgttgcaatttctttcttctagctattttaaaatatgcaatgaattattaaccataatttccctgctatactattaaatattaacttaattgcttgtatctaattatatttttgtacacattaaccaccttctctttatccctccccatcctttcatttccagtctctggtaaccaccattctactctcttcctccatgagatccaccttttccgctcctacatatgagtgagattatgcaatattttatttctgtacctggcttatttaatttaacctaatgacctccagtcccacccatgctgttgcaaatgacaggatttcattttttatgactgaataatattccattgtgtatgtataccacattttcttttatttttagttaagtaattaatttagagacagggtctcactctgttgcccagactggagagcagtggtgtgatcaaagctcactgcaggcctgcaatcctgggctgaagtagtcctcctgcctcagcctcccaggtagctaggactataagcatgtgccaccatgctcagctaatttttttttctttttttactttttgtagagatggagtcttgctatgttgcccaggttagtttcaaactcctgacctcaagtaatcctcctgcctcggcctccatattttctttgttaatctgttgatagacatataaggtgattctgtattttaactattgtgaacagggctgcaataaacatgggagttcagatatatctttgatatactgatgttctttttttggatatatacccagcgatgagattactggatcatatgaaaattctctttttagttttttaagatacctccatactgtgtttcatcatggctgtgctactttatattcccatcagcagtgtaccaccattcccctttttctgcatccttaccagcatttgttattttttgtctttttgataatagccattctgcctgtggtgagataatatctcattatggttttgatttgcctctccctaatgattagtgaagtttaggatttttttttcatgtacctgttagccatttgtctgtcttcttttgagaaatgtctatttggatcttttgtccatttaaaaataagacttttttttttttttttttttttgctaattgagtttttttagttccttatgtattctggttgttaatcttttgttgaatggatattttgcaaatattttctccctttctttatgttgtctcttcactttgttaattattttctttgttgtgcagaagctttttagcttgatataatcccatttgcctatttttgttgtaattgcctgtgcttttgaggtcctaccccaaaaatcattgcacagaccaatgtcctgtagcatttccccagtgttttcttctagtagttgcatattttcaggtctgagatgtaagtctttaatccattttgaaatgatttgtgtatatggtgaaagctgtggatctagtttccttcttttgcacagccaatatttgattctcactgaaatctcactgccctcctggaaatattaccggatgttttactgtcatagcgaagtgagagtaagctgctcactgaggatcaaagagcttgtgacagacctaagactcaagtcttctcacaccttcaaaatctctttccatcatacaatctactagctgctgaattcgcaagctttttgtgcaagctagtaaaaagcaaaatggtttgatacaaatactgtggccatgctaggtacaatgacatcaatttaaattatcattggtcttaacaaggggatgtagaaaggggtctcctactgacattttaatactcacttaaaagtagtatttttccttcagatttctttatattattagtataattactgtaagtatcctttactgctttatatgttgaattagctggaagtgccaaaagaaaaactcttaatgataaatttaaggtattaaggtaaatttctccttcatttaatttaatagtaattcttaattactatttaaaataaagattaaggtttgtttctagatgccatttaacatgatattccagactgccagttttattttcaaagtttgtttcatattttattaatgtttcttcataaatgacagtctttagaaaattgacggttaagctaggtgctttatatttttcttttcctgcctatcttttcactgtgctcctaaattttacatctctttattctcaagggttcaacctttgaagaaggggagcaaaataaatgaaagtggctaaaattttttctttaacccctagactctttcctgttgtgcattaattacatgcttgagtttttagaataattataataaagtaaaactaccaatttaattgtattgtaactgtgcaagatgggaaccttctctcttagagagataagcttttaattgaatagattaatggatcaattgttacctctgctttgctgccagagattctatttaatcacagaagttccatgtagtgctggagagctcagttgcctgaatctttttgcaaagcgtttactgatactgttgcttcaccaaccaaaacaaacaggttttttccttgagtcagctttgtaggtacagagatgagtttggcatcctatgtgacttttttttttttttttttttttttttttaccaccagaagctgttcagaatgttattttcttaaatagttcggaaaaaagtcttgatgtattctatgaaagcacaaaaatagtcagtttctatgacagctggattgtcaacgtctgttcagcttacgtggaggaggatgtcctacttgagtagtataggtagaaatagctatcagaaattgccgcctttgaaagcaatttgaaattatgtaaaaggaagtaatgacaaaataaagcaatttatgtttaatctggaaaagatccaaaagtaatattgtaaagagatcttgagtaatcatttttatcttcctaaaatagccgttgtttactcccgtaagcgagtaagaaacttgtgccattattccttattgggtgcatatagatttctcaccttgtcattcaactccttgcaatattcaactttacttatgcatccagccttatcccaaaatagcctcttccctgtagcagcttccttatcatgtagcagcctactctcctcaccgctcatccgttcttatacaatctggcttaagctctacctcttcatattatattcttctctgagtaatttcaactcacactgagtcttactttcagtatttctattatattggtatttattacacatcacacttagatacttttccattagtctctagagggtacatatatgcactttctctttttttttttttttttgaccatgtcaagtatagttctatagtataatagaatgaattggagatcctttacatttagagagggaggagtctacagtaggaagaataggttaattttcatctccggtttgaaatcaggactttcaatttttttttcagaggtaaagagcaacttagtcaagttggcatcttgtaaacagactgagtgaagatatacttaaaatgcatctataatttcatattttatttcgaaatgtgaaagagcctactaggggtgtctgtgatctctagaccttatcaattcattctagagaaatctggagggagccattgaggagttctacctcctgtctattttatagagctctttctctttttctcctatcagatgtagattcaattgctaaaaatgccacgtttcttgcctctattattctagcttcattacttggggagcagccattctgataacttacattttgctactaaaatctccaacttcacctaatccttcattataagccacttcattttttcctataattaaaattttaaatatgtggaggaaattctgtcaggtagatatgacttaaaacctactaagggccaggtgcagaggctcacgcctgtaatcccagcactttgagaggccaagtcaggaggattgcttgagcccaggagcttgagaccagcctgggcaacagagcgagacccctgtcttcacaaaaaaaaaaaaaaaaaaattagctgggtgtggtggcacatacctgtagtcccagctacttgggaggctgaagtgggtggatcacctaaggacaggagttctaggctgcagtgatctatgattgcaccattgcactccagcctgggtgacagagtgagaccctatctcaaaaacaaaaacaaaaccaaaaaaaaaaaaaaaacaagaaaaaaaaagtactaaggatctggtatagccattcttgcacttaataatcttggtacaacctctaaaactattttttatagtttattttattttgccttatttagacaattggcatgtctatgttcttcataatttagaaattatatgtatttatatatataaattatatatattatatattatgtataaattaaattatatatatatataatatatatatatttgaaatggattcttgctctgtcatccaggctagagtgcagtggcacaatcttggctcactgcaccctctgcctcctgggttcaagcgattctccttcctcagcctcccgagtagctgagattacaggcgcccatcaccatgcctggctaatttttgtatttttagtagagactgggtttcaccatcttggccacattggtctcaaactgccggctgaaatgttgtattttttgtatgtctttctggtatgatttttggagaaaggtgtatcctaagaatacggcttgcttttgtttctgggtaagcattttagggtatcattttgttgtataaccattgtttacaagtgagataagcatctattccactaagattgaagagattcatgtttgactgagtatgctctattaacattctttaaaacatgtgaatatatgtctttcttgttttcaggtgggttggtcacttctgtgcaaattaatagaagtctgtccaggtacaatgcaaagcttaatgggaccccaggatgttggaaatgattgggaagtccttggtgttcaccagtaagtatgatagatatgtaaaacaaatggccttgagtatttatttgtacacatgacaaccttcccttgatacactgtgtttgcaatccaaggctactcctgtggaattctttaaaatacagatatttttccttgagtcaatgatttacatttatagagagctttaaactcagaagtttgatttagaaagcaaacatttaaggtaacatgtcagaagttattattttaataatataatcatataattataaaactggttaagttgtagatttttgatgagtacttttgaattcaaaccatgaagagattttggcttttaataatagaatcgatacaaaccactagttcttaaaaaaatgggaactgagaaaagttagttctgtaagtagtaatttgaaagttgatgttctactgtctttaaatagtacatttatatatatattcctatatatacagtaagtttaaactatggctttcagaaagagttaagaaagaggaaattaactttcagcacatctgtagccaaatcttgatagtaattttaccagctatgtttttgcagtttgcagcataatggcttcttagatgagactacttccttagccatcattaattaagaaaatattttctcaagaagaatgtgtttccaggaaaatacattttggatagctttgtttcttgacagttaaaaaatatcttctaagctactgaggaggctgaggaaggagaatcacttgaacctgggaggcggaggttgcagtgagcggaggttgcagtgagccgagattgcaccactgcactccagcctgggtgacagagcgacactctgtctcaaaaacaaacaaacaaacaaaccttttgtcattaactttaaatcttttttatacctaatatgacttttctttatcacagaaaaggaaattgtgaatattttttggcttccaatggtatatggtttatgaaaatttaatttatgaaaaattttcaggtgtttgtattgctgatcagtgtcaagtagtgctataaatttagacaaattagagctatgtgtttgtccataagtgaacatgtctgtgcttatacattttcccctctttgacaaatgtgttgctcttcttgttttcagtacataaagggtgtgttttggaaagagcatatttacaattaattggagttctcgtcttcaatctaatctctgtaattctatgtatcagttctaaagtatacagcatttgatgaggaattactcaaaatataccagtaattaggaattgtaactttaaatgtcccttggtttgggtgataatttccaggaagtccaaagatgagccagtctataacctcagggagtgtttgggaaactcatctagtcatattcctgtacaaaccaactgttcaaattaaattacataaaagtttatgtaggaaatttcattcactcactcacttactcattcactcactttgttcatccagtcattcatcttctattcattgaatgtttttgaagcctgtcctctgggtcagaaaccatgcagttgtgaagaagatagacacactgctgtctccagtggagtgtattagatcactcccagcaaaaattgattgtaaaacagatttctcttttttcaaggccttttccctccaaagacttaccagtactgaagaaaaatttcttccgtggtaataaagtcaggaattgtgggaatggtatagggagaggtaggggcagggtgattaggaggaaggctggcagagaatcgaagactggcttcattcaggtcctccaattgccaaatggagattatgcaacgtttcttgaatacatacaaaactctagatgtggccagctcagtcttcttccaataatgtaaagccaaacaatgctttgcaggaatagactagagattatattttgggattaataacatagggattaaaatcttatcttgaactaactaaacattattgatatgctaaattcactttttttttttttttttttttttttttttagacagagtctttctctgttgccaggctggcgtgcagtggcgtgatctcggctcactgtaacctctgtgtcccgggttcaagtgattctcctgcctcagcctctcgagtagctgggactgcaggagtacgccaccacgcccagctaatttttgtatttttagtagagacagggtttcatcatgttggccaggatggtcttgatctattgacctcatgatccccccgcctcggcgtcccaaagtgctgagattacaggcgtgagcaacggccaccggcccactactttttaatatatcattaatttctcttttaaaaacagtagcaatcaataatttaaatattcaaatgaattcttaatttatatacacaaactaacatctttattatatctctatattttaatatatcaacatgtctaagataatttataaatttacatcatatataaaaatgggtttgctctcgatgtatataaggcttcatgatattttgaatatggagttgggtgaaaatagtgaatctgaatatttgaatttgaatatttattggaaaataagtagtgcttttaactttttaaatgagacacataatagtcccctgttgatttttttttatttttttaactttattaaagtatagttgacaattaaaaattgtttatatttaaggtatacaattgatgatttgacatgtgtacattgtgaattattcaccacaatcaagctaattaacattccctgttagtttttataagcctggttcaggtttgtagaaagaaacaaacacacatggccaggcacggtggctcacacctataatcccagactttgggaggccaaggcaggaggatcacttgaacccagaagtttagaccagcctaggcaaaatagcaaaccctgtctctccaaaaaagaatgaaaaaattagcctggtgtggtggcatgtacctgtatccctagcaactcaggaggctgaggcaggaggattgctcacttgagcccaggagtttgaggtttcagtgagctatgattgcaccattgcattccagcctgggtgacacagcaagaccctgtctctaaaagcaggcaacaaaaacacatgagcttcactacagggaattaaatacaatgagagtaataaaaaataggtgagcaaaaaaaatgcaaataagcaaacttttgagtatgatatttcattcttatcttgatttctgtttttaactccagattgattcttaaaatgctaacagttcataatgccagtgtaaacttgtcagtgattggactgaagaccttagatctcctcctaacttcaggtaatatgtgtatatgttttttgtgttgattcaaattaaaaaaaaagttgataccattaagtaaatgtgtgtgtgtgtgtttttttttttttttttttgaagatcaggattagggtagcttgatttaaatgtcctaaaattgcatctgtttttagacctagtgatgggacagccataatataatctaaatatcagttatttccaaaattctttctgtttccatctcttctccttatctcttttctctatactttgcctctcaaaaatctcattcaatacattggttttaaacattaccttatatattatccccaaatctctgttggtagtccgatgtttgctcccaaaatctggacctacatctcatattcccccaggttagtggtcattcctgcccttgccattattacttctttctccctatatatctttaataaattttctataatatatgttctggagtatgccataatcgttacattttgaaaacacatagtattacttcttgagtatttgctagatgccaggcttcacaagtaaaatgcttcacgtgcttttaaacacctgaatctgaaaacaccccttgagatagggattttatctcagttttctaagtgacaaacactgaagtgcagagaagttgctttggccactaagaggtagaaacagggtctgattctccatgtcaggttccttccctgagaaaactttggcctggtagataatggacctgaaaacaaaaaatcttgaaatgatgcaacagttgtgggcattgctgtgctggacactggctattatataaggttccgagaagaaaggccgctcacagggagctaatcttgaagggctgggaggagtttccttccatgtaggggagggctttttaggttgagagaagtatgggtgcagaggcctgggaggatagcatgagagaggctggacgtgtgattgggaaggtttgaattgtcctcatcagtcctgctaagagatgtaaagaccatgctggagaaagaggaagatgagagtatgagggaaaaacaagaaggtactcaacatttcactacagctttttatgaccatgttgtatggcatgcactaagagtctttaaccatgatttaatttaacctcacccttgggaggtattttttttttgacggagattcattctccatttggcgatggacaggaagatgagggtttattaatatgaaaaatctaccaacactggaatatattgaagttagcctcatacagtactactactcctattccagtattattatttttattgacagaatagatgctgtttgtgttaagttttggattatgataggaaatgtttggtatagtaaaaggcaagagtgtgacatgcagttagtccaagtacgaagagataccaaaaaaaaaatgtttagtgaggagcagagtttagcatatttggagtgaagacaatgtgcggaaggaaaggagctgatgagatacatgtactatagtcggttgtgtgaaaggtcttgtttttcatactaaggatcatgagaagatcttagtagattccagcaagggatttgcaagaccacatttgtgttttagaaatataatgcaggcaataaaccagttggatagaaattggggactgtagagcaattaagcaactgtttttgcattctagatgagaatgcaaaacacaataggaatgaaggtgccttgttcaaaaggagttttgttcaaaaggaatcttcaagatgtgtaggagatattcttaaaggacttggtaatgaattgatttgttgcttggatagagaatgagaagagaaaggagggtggaagaaggaagatgacttaggagtttctcttgggtagctagtggattatggtatcattgatgaagacagggaacaggagtaggccaggtttggggtaactgtggaatattcagatgttgtctaagaggcataagaatgtatttcagatgtttggggcaagttgtctaggctagaagtactgattgagactcatgaaattatagtaaagtgaactgggagtttatctcatttataaagatctagagcttgataagtctaacatctagggcagttaagtagtttatcaacaaacaaacaaacaaacaaacaagaaaaccatgggtctacaaaccattcacagtcttcatgtaaaaattaattcatgtaaaaattaacacattaaatgttaaagcagctctttactcagagcatattattctctttaaaataggtaaaatcaccttgctgatattggatgaagaaagtgatattttcatgttaatttttgatgccatgcactcatttccagccaatgatgaagtccagaaacttggatgcaaagctttacatgtgctgtttgagagaggtattttaaaatgtcaaattccttaaagtatatataagaaaaaaaggcttatactgggaaaagtagaacacagttataataagaagaaggtttctaaaatcctactatttattaagaagtgggagttgtctgtcaagggtgaggaatggggttaattcagaagtattgcttgttttggtggggtgaatttcattcgtgggttataaatcatgcccctggagtagactttcttcaattgcttaacaaggcataaggtttactttgaaaactggatgtgtgggtgctatgaaagaaaaaataaaactgtgaagccaagcataggttacactgggattatgatgttgagtcatcaccagaaatcatagaaattgcataaagagcctgaaggtttacaaagtgtccttcaggaaaaagactaatatgcatttcatagcctggccctgagattgataactgagattattatgtaattttagagttggttggagtccttgtttagtctttccattgaccttaggaggaagtgggtcacagcagtgaagtgagcatcctgcctgaggacacagagcttgtgacagtacagttcaattagcaattattttaagagccccttttgtatcattatgagagccaactgtgctaggggtttagataagaatgatttatgtgggccctgtgtcagttatcagtttaccagtctaatttcttgcagttcccagaatgggatagatcacctgataactgttgaattccctgtctcctcccagaaggattttaaacagcttatagataattataatacacaagagtaaacaaaatggatgagaaaataggtgaagggacaataatataaagctagattaagtttactgtgtttctaaggtcctgcatatttacaaaggggtgggccagaaatttgtctgtttgcttcctatctgacaaagaaaagaggtaaatatcagtggttacaaagttccttaagataaaagtaaacctattattcaggagaagcaattggtctcatgggagatctgagaaacatcttcccatgggttttcctggatgagacaataaaggacatacattttgcaaggaatacaaagtgtattgcagcgagagtgactctgtcaaaagtcagaatagcatgggcctggtacccagctctttgataatcatacaccgtgaagtagaagatagtttacagcgagtacggaattccttcaggctgtcatgtataaatgttctatcttgcaactaagctttcgatgacaattaggataaagtttgaggttctattgtcttgcagggtctgtaatcttctgtgtggaaggttaggggcacattcttcttcctggaaggagggctagcatcactttatcaccatcgttgtttagtccatctaagacactggaggtagaccatagaatgttacaaagaagaatgttgctcaatagaaaaaccatcagtgctgagagggttatgactataaatgtagagtagaaaaatttctgatttttccaggagtatcaggttctccaggactcaggggtgactataaagttaattttcaaaatttgaaagtgtactgtggaaactagaccataaagtgagaaagttccatgatattcttcacttgttaggaaaacttaactgatttcacattatattatagggacactctggcataaaattaaaaaaaatgaatgttgatcacttagagtgctgtgttttctaacatatttctggcgccattctcaagctagataaactataattttatacatgtttttcaggttgttgcccaataacaatgactccaaatggaacttactggcttgatcaaatgactttaattgtgaaaattaatgatttatatttttgctgtctgatggaaaaccactaagacagagtatttcaaagtctgattacttgccatttgctcaagttgacaactcttgaactgaaacatttagccgagctgcccttcagcagcctaccattaatgcctcccttttaaatattgcaatatgtccagttccagttggccatctttattagtcactgtcagttttctctagaatttcccaaatgaaattgtaaataattttgtttttctgagaactgcttgctgactagcacttttacatttcaaaacatggagtacctaacataggccgaaacaaaattatttgaatctccgtagcttgttttctcattataacattcttaggaagggctgcttcacagaaatatattttttatttaaggagattacacttgatgtatctcacacaactataatgaatattgtaatttttgaataattaaactttcatatcatctttaagcttattcagtattttgtctttcatttttaagtctcagaggagcaactgactgaatttgttgagaacaaagattatatgatattgttaagtgcgttaacaaattttaaagatgaagaggaaattgtgcttcatgtgctgcattgtttacattccctagcgattccttgtaagtagcatttaaatgttatttattttttgtatctgaaaaattacaatatatctcattctgagtatattttaacaatatttttattatttagaaacttgtggatgctcaacccattcattcatttattcatttaattaatttacattcactgacattatactgaagttggctgtgggcttggtgctggagaaacaatcgtggaaaatacagatgtgttccttaccttttcagagcttgtagtacaatgggggacacagataagtacagaggtgattacagtggcagaagtgatggcagatggcagaagtacctagagttaggagatcaaataggaagtgaggcagtgtctcttagcaaagatttaataagtggagcttcctgtgcatgaaggtgtgacctgaagtgagaatgcaggcaaagtggcccaggcagtgggcatggttaatgtaaagatgctggagcaagagagagcagactgccttcaagaagacaaaagtagctcagtaaaggtgtggggttatgagtgtgcgtgcatgcatgcgtgtgtgccgctgtgcatgcacatccccaaatatcctatccgtttgtgtttcattgacagaggcaagggagagcttgataagaggcagtaaatgaggccagagacatggagtggagagcatgaagggcctaaaaagccacatgaaggagtttgaattttattgtgactcttgattagcattttaatgaggctttgaaatttagccacatttttcaccaaaaatattaatcagaagaaattaatttgatgtgtatgctaccaatgattgctattaggctaaaataatggttcatattctgttttgttttgtattaatggttcatattctgttttgttttgtaagtgaccattaacactttgtattttatgtattacttgtgtgggtttctacaggatatacatatgcatttatctagtgatattttcatcctcacacatgtgaagttttgaggattagagttaaacaatgtacctggtatgtaataagtgttctaaaatcactgacaggattattagacaatatgtattttatatgtgtgttgtatactatatgtaattgcatttatggtttcagatatggaaatcactgtgtcaatctgaaggtgtgagccttcggtgtaggcagagtaaaacccaatgcccttgtgaaagaatgcttttttttggtgatgtttataaaatcacaatgttttcttatccacaggaaattaaacactggaaagtgggtggggctgaacaataatagagaaaggccatggttttacatttctctgagacatcactgccaacaaactgaatatgtttttcattatactttttccttggctatatttattcatttatttatttattttgggctggaggtttttggaatccattgttttccacccacattggacataactccagtaaaaatgtgttgattcataatgcaaaagtcaagaaagtagcagctaaaaattaagaaatcaaaagtttttaaaacactgattctaactgaaaaacatttgcttttcagtctttaagtctattgttctgagtcaaagcagttcatttccttacgttgttaattttttttctatgtttaagcattgtaatatactttttgtgaaaacagttgattagttttggttgtgccaaaacaaatactaaaatgttttgcaaacagcctttttttaaacaaaaaaagaacagttaacatttgatgcagagatatacatgttttctccatgtaggttcacacctcacttcctttattgattaattgctttttctggtagagtctttctttcctttctgttttacctgtgtttgtccctaagacttatattttaatattatgcctcctctctttcgttctcccatcttttcttccacctattttggagccttcaggaagcttgattttgctgccttgtacattggttgcccttctggaatggaggaaacaggtcatagctgattttaactgttccatctggtgacatattcttgattttctttcttttggttggggaaaaaaaaacaatgcaaaagtcattctccaatggggttgagcctcgttaagaaatagaccctccacaatggttgaactagtttacagtcccaccaacagtgtaaaagtgttcctatttctccacatcaaaaaaaaaaaaaggtaagcaatataacatgagccatatctaataggacttcagaaattatctatcctatagttccaggatgacgatgatgatggttgtgataatgatgaagattgtgatgatagttatatgggagataaaactttaagcactttacatattaaattctataatattcaccacatctattaaaatatgttacattattgtccctattttaccaacaagaaaactgaccaacaagattaaacaacgtgactaagttcacacaacctgtaacagcagaatctatgtcaatcacaacacaattagcagctatttctgtggcaattttcaataaagatgtgtctggaaaaaaaaaaaagaaatagaccctccaatttatttatctgaaaacttatgaccaatacattacatttccagactttcattttcagtacttttcctttcattttcagtactaaaagtactctgaatttttcctttttttgatcttaaggctttaagccaagaaacaggaataaagtaaattttccttaatgccaaagattagtcctacaccccattatgttattaatgaacagcatagtattttttacagctacttaaagaacatgatgtttaaatttggaaatgcagtcattatgctgccatctatttacagtctatataagacgtctttgtatgcatatttgaaaggagaacatggttaccttattgataattatgatctctttaaattcaggcaataatgtggaagtcctcatgagtggcaatgtcaggtgttataatattgtggtggaagctatgaaagcattccctatgagtgaaagaattcaagaagtgagttgctgtttgctccataggcttacattaggtgagtttcttagttaatatgtcatcacacactgtatgatatacatatacatataaaacatatatatgttgcataataatggataagtagcatattgacatactttgaatgaaaatattgtaaaatcccagaaaaaataaattaaaacaaaaagaaaatactgtaaattaccaaactgttctgctgtgcttagatggacttttaaaaggagtgtcaaaaatagatgtgtagaatgtaaaagaagtattatcttaatcttatttttatagatgtagttctatagatgagtttttttattgttgaggctatatttaaaatataattatgtaagaattgatacatacaaaaatatgcataacatatacaatataaagcataatgcaaataactcactatccaacttaaatgttgtatattcccagtgggggaagctaccctgggcttcttcctgcccttgctttctctatagaggttaacactatccagaattttgtgtttacaaatcttttgtttataaatatgatttactacattttcatgtttctctaagcaaaattgttaatgtttgcctgcttttgcttcatcaaaatgtaatcatactgtatgttgtcttctgcaattttcaaatatcagtgctatgattataagaatcagaaatatttttgcatgtggttgcatgtagtattctattatttggaaataccacaatttatttttccatttttctatccatggacatttggattctttcttattttatgctactactatctgtgttaaaacagataactgaaaaagaacagttaacatttggtgcagagatatacatattttctccatatataaataagggttaatattttaaaaaatatttatttgccattggtatgtccttctttgtgaaatatgcaatctgtcatttatcaatattgttcacaggatagtctgtctttttaaaaccgattcatagattctggataataatgttttggtggtaggttatacgtattgaaaataccttcccttgaacatcacactctggggactgttgtggggtggggggaggggggagggatagcattgggagatatacctaatgctagatgacgagttagtgggtgcagcgcaccaacatggcacatgtatacatatgtaactaacctgaacattgtacacatgtaccctaaaacttaaagtataataataattttaaaaaaaaggagatgaagaggtagctgcaggttgactgagcaagggtcattgtctatttgaagtttcaaaggtatctctgaaaataaacacagttttttgcaagagtgaaaaaaaaaaaaaaaagaaaataccttcccttgacttgtagcatgtcttttcaccgtctttatggtggcttttgtgatatagttaaatttaataatcagttcctttgtgatttactcttttttatgtatcttgtttaagaaatcttaatctgtcctttccctaagataataaatatattgtatattttattccaaatcttactcgtttgttaaactgttgcagtttgtttttgtaaagaacccaattccccctctttttttcagtgtggagagctagttaccatcacagcacaatttattagaggttcacctgtttcccagtcatgtggtatataaatatgtaaacatatatgcttatgtttctgtccttggcgttctgttgcattaatctgatttgtctgaatcagatttaaatctgatgttaaatataacactatttaaattaatagttctgtaagtcctgatatctgaaaagctaataggtcaagtcaccatacattcttttttaggcacagcttgccttttttcttgggcctttactattccatgcaaattacaggattaacttgtccagttccttggaaaacactgttgagattttgactggaattgcacaaaatatgtggatcattttaagaagaactgacatctttacattataatttcttctatacatgtcttgcacatcttagtttttgctacgtatcttattttttattattattgtaaatggtatttctttttaaatcatatttttgaactgtgttttcataaagaaatgcaaatgattttttgtatattgaactaacctacctttctaaactcttcgttaattctgacaatttgtttctaaatgcacttaagttctctacctagcaattatataatttgtaaataatgacagtctgagttcttcctttctgcttcttatattctttatttcatttccttgtcttcttacatgagtcagaattattaatatagtgttaaatagagccattgatactagacatccttgtcttgctctttttcctgattttaaacagaatatttttaatattctcccatccaaaataatgcatcttacaagggtttaaacttttaaaaaaaattttgttaagaaattttattttatttcttctttgcttttgttttttcaatgtgggcttttaaatgtttgcttttatttttacaatgtgggcttaaaaatattaaaatatttaattttatcaaatatacttaaaatgtagtaagtcttttttttccttttcattatgttaatatgaagaaatacatctacaggttttctaatactaagctactgtgcacttcctgataaatttaacttggtcatttattagatttttaaaaacacttctaaaaaatcttctctgtttattttcacatataccaggtgagttttggcagcctcttgttttttcttttttaccctttcttttttgttaaaaacatccttttatttatttaatgattaatacatggctattttgtgttttgtatctgataactatatataaagttctggggagtctaaaccaactgcttctaggctgactgcctgtcagttgcggagccttgttttcttgtatggttgtgagtttctcttttattgagcatcctgaggacttaaattaaagatgctctttcagaggtgtttgccaggagtcagagcacaggactgacctgggagcagtttaggatatgatccaggcttaatatgggagactctggttgagaccttaccttgcagagagtctgaaactggtttgttgaatgcagcgccaggattcatgctttcccacaagactactctggcgttcaactcacagctcttgtttcagcttctttttgaactccctctgcccctcaacacacaccttggaaatttccttgatatttttgtgaggacaacaatgcatttaaaagtgagagtggttgctgaataataaggaatgatcgttaactgttggacattgattctgatgacattttctcaaaaggataaccaggaatattttgtacaaaattaggattattataataggcatttagtttttcattgttacaaattttgaggaaaatcattaatcatttgaaaaaactaattgacatgtctccattgtagcaacttgtattttcacttctagtatcatgattatatcccctgtgtaatttggaaattgattttagcattaggaaatttcctagtttcagttaaaatgaattttttgtaagctgaattctattttacatgcacaactttagtttgttatttctttccttgacaagcatttattgaatgttgttatatgactaaaactgtaagatgataatgttttaatattttcacatttctttcatagcttccaaagtgtatatatatactcacatacttcatatatatgaatctacttatatactgtatataaaaatatgtatataaatatatacacattgtatataaatgtgtatatatatttacacatgtatataaatatacatacaaatgtatataaatatacatatttatacacagatgtatataaatatacatatttatacacagatgtatataaatatacatatttatacacagatgtatataaatatacatatttatacacagatgtatataaatatacaaatataaatatatacatttatatataaatatacatatttatacacagatgtatataaatatacaaatataaatatatacatttatatataaatatacatatttatacacagatgtatataaatatacaaatataaatatatacatttatatataaatatatatattttttgatacgtacaactatcttgggagatgggatattgttattatttccacatttacagatgaggtcctgtggttcatcaatctttgtgttttattcaagattatgtaagcagtaagggatgaaatcaggctgagaacccaaatttcttcatccctaaacaaagtatttcttctaaacatggtatccatttactagtttatctctatcaggtgaccctttattcattatttttcatgagaaggttgtagttgtacaaagtggctgatatctgataatgttttaatctaattcaaagtcgatttcttaaatccaggtgtcagagtagcacactactgtacaattctctgtttcatgttttacaatttaccacagtcaagttacaacttgcacatgttacattaaaatgtgaattcaccttaatttcttgaaatgagccagaagaagaagtggttttgttttgtgatcagggaaatgctacttgactgccaaattgtctagaacagcacattaaagttgcttgattttatactgttaaaattaaataaaacatggcaactgtcatgtcatatgtaacttttgtattattctgtaactttttttgaaaataaaaagtgatcaaattgatcttcaggtaaagaatcttttttctcttgattatctcttagtggatgatgatttgttccatttaatgggtagagaatttattgttgctgttattgtttcaaaagtagctgaatgaaactcttaactttttcttcatagttaaaattaaaacctcaagtaaataaatatttaacgttttgccaaactatgtaatctaattatgggcttaatgcatttaaaggctttgtataatttgctacgtattttcacacaagttacctgaacataagtccagtcttcctgctgttttctgagtcacacagtgattcagtgaccgaacagctgttggcagtggtgtgggtataatagggaaaagagactgatggggacaacccaagtttagacaagctggtaaaagtagaagaaaatcttcttgaaaacactagtgatcactaagggctgtggagaatttttgcttggtgggtgaatgtggaagaggcaacagcatgggaaggtgttggtaaaggagctccatacttgcttaaactgccttttgattgtgaggccgttgatgaatatttagtttgggctttaggttttttatgatacaggatattttccatttctggctttgtatctcagagatcacttagttacacttatagatgaataggagtttcaattccttgttttagaaagaagcttggtaactgttagtgagttacaaataagccaaatagaagaaggtacatatttctgcagtatcaggtaaagtttttcctcataaggatttagactcttggatatcatattaattctcagaagagtgggtataaaaaggtatgggacttcttcctggggtgggttggaggtggtgaaatacctttttttttttttttctgagatcatcatagacaagatcaaataatggtaaacatgccaatgaattttctaagcactattcctttaagtgaaagaagagtgtttcagtaaaatgatttaatattgggtcttccaaaagatggatttaagagtttcaactttaaaagacagaaaaattaagttattttacacaatgaatattgtcgtgccgtgtgtcacagacatgacatgagagggaatcagagaacatacagttaatacaacgcaaactagtatcattacttttgctcaatcacttccattgtctaagtaagataattaaaggacagcataaaataaaatttcaaaactttactcaatcatattaagctattttaattaaagtaaatgttttaatgccattgaatattcatcaccattcaaaattattgatgtaaatagtgttatatgttaaaggtaatttaacttccatggatgagaattcagctaatgtttcacttaacttttaggtaattttttcaatatcctggtattaaacgaagtccatgagtttgtggtgaaagctgtgcagcagtacccagagaatgcagcattgcagatctcagcgctcagctgtttggccctcctcagtaagtaacttcactaaaaaggggattcttacagaggcatttgacatcaaatatgaacattgtaacaagagaatcatatgtacagatggaagcattcaatgccttttctgtcctgtgtagctcattttccagtagaggatactttcaaggaaactaacagttgtgacaaatatacacatctcaatgtagagttttgctttacatcattcttgatttagctttgtcattaagcagctaatctgttttaaaaaaatttttatttgtgcctgggcatggtggctcacgcctgtaatctcagaactttgggaggccgaggcgggtggatcacaaggtcaggagttcgagaccagcctggccaacatggtgaaaccccatctctactaaaaatataaaaattagtctggcatggtggcgggcacctataatcccagctgctcgggaggccgaggcaggagtatcgcttggaactggagggtaggagttgaagtgagctgagattgtgccactgcactccagcctgggcaacaagaatgaaactccatctcaaaaaaaataatttatttgtgttttaagttctggtgtacacgtgcaggatgtgcaggtttttcacataggtagacgtgtgccatggtggtttgctatacctattaacccatcacctaggtattaagcccagcatgcattagctatttttcctaatgctctcccttctccagtcccatcccctaacaggccccagtgtgtattgtccctctccctgtgttcatgtgttctcattgttcagctcccatttataagtgagaacacgcagtgtgtggttttctcttcatgtgttagttatctgaggataatggtttccagctccatccgtgtccctgcaaaggacatgagataattcctttttatggctgcatagtattccatggtatatatgtaccacattttctttatctagtctatcattgatgggcatttgggttgattccatgtctttgctcttgtgaatagtgctgtgatgaactaatcttttcaaataatcctcctctcgtctattaggttttttttttttttggtaccttcttcctcattttattatttatctggataggatggtagcattatgagacgtataatatattaaaaattatctttataattgaccaaggcttctcctaaagcacacctcattctgttggtaatatttcaaaatatggacttagagttggtcaaactgttaagtagataatatatataatgtttttatatatttttcaatttttttcaagctgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggtaggactctcataaatattagagttattcaaaattatgttttccagtcatttatattttgacagatttcttttttctcccctaatccaggaggccgcatgctgggcactaaataatctccttatgtaccaaaacagtttacatgagaagattggagatgaagatggccagttagtagttttgattttatatgatagaaaatttcagttatattttaaatcaatacctataaaataccttaaccgtaacttttattgttagaaatatttttgatataggcatttagttttagatgttgctgcaaaatagtagtaggtatgtagtattttgatctcatcaccttcaggagttagaaaaggtagaatgagagttattattgagagatttggaatcaagggtcatttggtaattcatgaatcatggagaaagaatctttctattttctggctgatcgttttaaaatgccatattaattcatcttgggtgatagaaattgcagagccatctgtgatcttttcttctatggtgactagccagcaggttgtcaatatcagaaattagatttggttagagagcttcctatgatgagttcccaactgatgtgacagagttgacctgtcttctttcgagagggttatttgaagctgtcatctctggataactctttcaataggagtgccattcaaacatcataagaccggcactctctcccaaagatacaagctgtagcaaggagttttgtgcatatcaggtttgtttcatatccgtgagcctttgtgttttatggcaactgattgattatacttgtgctatttgcaatgggtatcctctgggttttaaatagtgaatgacttattttggaaacaaatagtagtattctatgtctgaaatcttgaccgtctatttgtttaattatctattgctgataagaagggaattaataacacagatgctacttaattaaatattttcattttgacaagaaacagtaattcttttgaaaactatgctaaattggcatcttaataatctcatgttgagcaaggcttttggagattagggtaagggagattcatgtcgcagtttataaatttcagttcataggatacctatttttcaatatccataagataactttaaaataaatatattattaaaacaaagaaaatatatttacgttatacatctttaaaacctaccttgcttctttacaattttcagtttttcctctcttgtttccattctcttctcctcactttacctttttcctcagcatctctttacatatctgctgagcttttttatttctctctgctgcatatgcttttgaaaaagcataaaaatactaatttgttaggatttaattaattcgagtcttaaaaaatgaactataattcactcttgtaagtggaggtggcatgaaatattgtttatatgctcttaattgttgttagagatatttgataatggcaagtgagaatttgagatagttatttaaaagattactactaacattttgtttgaatttttgaaagtttcccagctcatagggaagtgatgctctccatgctgatgcattcttcatcaaaggaagttttccaggcatctgcgaatgcattgtcaactctcttagaacaaaatggtaagcagtgggccatgttttcaaataaagggaaacacatttttgtggtatttttaattatagaagctatatactgtgaaaaatttacataatttataaagctatatattgtgaaagatatctctatgtgtagagatgtattgacatatggattatgaatatataggtaaaaggatgaagaataaaataaacatttgttgtatatttttccggacttctatgtgtaaactcacacatgacatatacaaaattttatgtattttgtagaaatgggatcatattatactcttttataaccaaattttatttattctcttttttatgttgatacatgtgtattctcacattatcattttatttttaattttttaaattaatttttgtttttagatatggtctcactctgtcacctaggctggagtgcagtaccatgatcatggctcactacaacctcaaacttttggactcaggtgatgctcccacctcagcttcctgagtatctgggactacaggcatgcactgccatacctggctaattttttgcagagatggtgttttgccatattgcccaggctggtctcgaattcctgggctcaagcaatccatctgccttggcctcccaagtgctgggattacaggcatgaaccactgtgcccggcccaaattataatttttaatagctttgtagtttttcagtgcttgcctgtattctgttttatgaaccaatttcttactgatgaagttttagtttgtgtccagtgggatgtttctggaacccatagtaaacaccagtgatcactttcctcctctgttttcctttatacatggttcctattattttcttgggaaaatttcatagaaatgcaactgggtagagagctattcaccattttaaaatctggtaaaattgtctattataaatttccacactatacttttttaaaaaatcgttctttaatgtaattcttataaatcttatagctttgtataattatgaagagaaaaatggcttgtatccctttagaaagacatgagttttaagattatggttcaggctgctcaaatttcttcccccataaacaggaatactgccagaaatccttaggtgaaaactcatcataaaggcattgggacttggcagcttttgcaggacatttttagagggcaaaaaatagagaaaaacactgaaagtcagagacagagaccagtgtaagcatcagcttttaatagagaaactgggtagggtggaaaaaaaataaagcaaccacctcatgcatgtttctttatattattattgaagtcaaataaagaggaaaatcatttcttcttcctcttcctcctttttcatctcacctctccaatggcactttaataaaacgcttggagtggccagggcactgacagacagacaggggctgctctcaaggataatgagtcaaaggggaaggagagggaatcgctgttctcgaatctctcttattctactgtgcagttaaagaggtctggacagggatttcactcctgaaaatgaggactggactttgtggcttctgttggggcacctttagagtggaggtagacttttactatgtacagacaacattgtgttggtgacatcattcataaccacctggaaatctcctttgatatgcaaatcaaacaaccataactttgtgaaatttcgactgcttcctattgtggtgtctgaggactggttacattcagagtccaccctgatgtctttgttcagttttctgctctttctagttccttacttctttgttcctgatcacctgtcaagtaaaatgtcctcagatccttttgtattgtctttggagttctgccttaataaagcatgaagaacttgagtagctcgttcatcaactttcttgggcaatttctcattgaaagacacttgggtgtctttgggtgtgcagagctgagcatggctttatgtttttagaaaaaatggctacattggcaggcagaagaactgcgtccttggaatcatggaggtcccaaggttgcatacattttgtgtgacatttttcctattcaattaattaactaatatttattgagctcccaagtgtgtagtgtctgtaggcacttgggatgcattcattaagtaaaaatcccaggctcatggagtttaaactgtagtagggaagataataagattaactaaaatatgtaatatttgaggcagttaagaataaaaaatgaagcaaggaaggagaatatgatatgttagacatcagaggagatgaagttgtgaataggcagccaggaaagaaggtgactattgagtaagacctgcagggcgtcgcatattgttttttgcctctgaaagcagttaatttcctgttaaaatggagtggatgagatcaagagtattacgtagatagctggtaaatgcgatagtgtgtaaaatgttctataaagtctaacgtgactttatgatgaaatttcttcttctaggtttattgcttgcaattttcaaaccacacattgggttactgtctaggatagtgattcttaaagtgtggttcctggaccagcagcatttgctgggggaacttgataaacagtgtaaattcaaggaccccatacagaccttctcaatcacaaaccctggagttgagacccagcaatccatgttttaacaagctctccaggtgattctgatgcacactaaagtttgagaaccactaacccagtgtcatttttgtcttttaaagtgtcttcttggctagaagctagccactttgggaaaggttattacaacttctgatgtgatcaagcaaagtaaccaactctttattgtatcttaatatgtgatattctgaatgtgtttaaaaggtatgagtttttcaggctctggcagtattttagaatgtgtatgtgatttctatttatttccatgttttgtcctatcttcttaagatagactacttattttaaaagcagtacttaagttaaaactttttatgtttctttttctgccactttcaaagtgttgaatcacagtgtgtaatgttggaactgatatttttatagcggcttcaagacaattgatatttatgtggaaacttgaagacagtaggtttatgtttagtgaaggaagtttattacaaagaggaaaattggccagttgtggtggctcacgcctgtaatcccagcactttgggaggccaaggcaggaggattgcttgagctcaggagttcaagaccaggctgggcaacatagtgagatcccctctctacaaaatattaacaaaaattagccaggcatggtggcacacttgtagtccctggtacttggaggctgagacaggaggatcacttgaggccaggaggttaagactgcagtgagctatgatcatgctactgcactccagccttggcaacagagagagatgctgtcacaaaaagaaacaccaacaaaaaaagaggaaaattattccttaatcattattgctggaatatagttactttccacaaatagtgaagtgccagttgtaaagcatatctatatgtttcctagactttggcattactttgtgaaaataactgtaattacttatgttctatgtaaatgctttccattcatttgtatatgatggcatatatagaaattataatgtttgtaaagtccactgggataaatggacaaagcagctgaaggctgaaagcaaccaagccttttacagccccttcattccccacactcccaaaaagctgagtgaatggtcgatacctccacatgcttataactcattcccagcccaccagtgtctagcatatctggttagtcttagctttatataagtgcagttatttgtgaacttgttttaagtattggaatacaatttaactttcattcttattttggagaccattatttaaacagatttcttttttcctgcaaaaacactcttttcacaatggacagagacacggtgattacattaaaaccatctactctatgaataaaaatgttaaaaccaaaatcccaacaaagggttaataaaggcaaaaaaaattggaaatgacatgtgttttaaagaaataaacatgaattatctttaagctgtcaatgaactataaattatgtgtgctcttgtatatgctttcctgtaaatttggactatattaatattctaaagcttatggtaaaattatgaaaatatgctttcatatctataagtaacattttaaaaaatctcagttaatttcagaaaaatactgttatcaaaaggaatacacctgaatgttttggagttaatgcagaagcatatacattctcctgaagtggctgaaagtggctgtaaaatgctaaatcatctttttgaaggaaggtaatatagattcattaacttgtacagaatatatcatattgggccaggtagaatatcaatatttcaagcatatttctaacaatgaaaagaaaaagaaaaacataagacacttgaaaactgaagcattttgcaatgtaatctcgtgtcactagtaccatagacttactttatctgaacactgaaaggaatggcaagattgtggaaacatgttgaaggtttgcttttgaacctgatgcttgatgttgactatattttgaaaagtggtaattgtatagcacatagcatacagcagtttttctaattattgtgtgtgtgaaagttataaaagataaaatcagtttatggctaaattttgctctttcacaacgaatatattattccttcatctgaatgaactttgtcttctcttcctgctctcaatccttagttagggaaaattttaactacatctagtccaagtgcagagatgctaagattatatagctggcggttagtggcacaacagagaccatatcctttgatctatgtgtggatggtggtggggcagggtgggatgaggtgggggtgaggggtggtaggtgtgggcagaactctcatgtgtaaaaaaaataattggcacagaagttgcagtgaaaactaattttgttcctggttttgccactaatttgagccaactgtttcatctctaaaacttcacgttcctcattgataaagaggaatgataataacaactttgaaagttgtaagcttagaatgtaaggattaaataaattaatttttacaaagggattaggataatgcctgctgcattttaagcactcaacaaattgtgtctattgttgttatactgttactaagtgtgaataaatgaagtgcatatagcatgaaatgtagcgtaactgcagacttgtaagaagtagggttacactgtttttaacatcagtctaactaatctatgtttatatatctttctaagctgtatttctcttatttaagtgttgtttttgaacactgagatgaaaagtttatcttaaatgttgattttaatggggccggaagtgtgcaaacctttacaaatgaggcaaaaacacagcggaataaactccagtctaggattctgtagattctgggcaaggcatttaatgtttctcgctgcatgctcttacgtaaaatgtgtacagttgcagccctggagattccgcattggctctgacagtgtgtctgcccctacagaactcatgtgagtcgagagactgataagtaaacagattattataatacagtctcagaatgcagtggcagtagtgtgtaaaagacgcaatggtaagagtagagtggactcagctggggttacccaaggaggggaggctccaatggagggatgtgtttaaactgggactttaagttggaaaagaaggaatgtatctcagtgtccacagaaccatgcaaagtgagaacatggttctgatatgcacaagtttcagttaacaagcaaagcaaggattgactgtattaaagttcatagtacctactgcattctagtcaagtgacatttgctcatatgtaaaagaaagaatagcttaaatacctgagagaaaccaagactgtaaaacaaattaaaaataattaaaaataccttataagaagtccagtgatgttaatctggaagaggaaggttcgtgtgatgtaaagaggccttgtcttggggtcagacaagtttgggtaccagccttgtctctgtcactttctagtgataagacctgaatatttaacctctatctgtctaagttcttcatgtagaaaatggggataataacacctacctgctgggattgttgttattgacccatcgtaggtcagaaggatgttgttagttttatgaagtgaaataattcccggattactatgaattctatcttatgagttcaaagtttagacaattaaaattatgtatgctcatactactgatttcaaatgcattttcatatagtctttcctgataaaatatattggttctgccctcctgtacttatttcaatttggtgtttataccattgaatcagatcagtctttcaataagcatgccaattttatatccccagcaacacttccctggatataatggcagcagtggtccccaaaatactaacagttatgaaacgtcatgagacatcattaccagtgcagctggaggcgcttcgagctattttacattttatagtgcctggtaagttacatagttgattgtgggaagagataacaatttaaatggatttttgatttttcatgaaatagcaatattctaggcaaatattaaaagactagtttctgtcgactaaatgtaaatctttctgttaaaccaaaaagaggttaaatatgatgcagaagagtcacttagattaatttttataagaaagcaatatgaattcagtaatttatttatacaaagtaactacaatgtaaaatgtggagcttttatttttaaggagggtgttcatctctgataattcttttctatttttgttgccatgacctgagttcaagctttttttctcttgtttgaattgtactattagctaattttcatacctgttctcttccttcatttctatccttttcttactctatgattgaattaatctttctccaatgtggcttgtactcatttacctcaatggcttccaccctccacccacctttaattgttactgacatctgttatcaccttatttgttctccaaagcccctttaaaacacctatgtctgtattcatccaacacatttattaagtgcttcttatgttctaagcactgtgatgctgttaaactttaaaagatgaattggaaaaaaagcacaactgtactattataggagcttagaggtagatggaagtgtaaatagataattaacaggcagcgtgagagaggcgatgatagatgcatatataaaaggctttgagaatatcgatggaggcacaaataatttcttcaaaggagtaggacagagattgtaatatttgaggtggaagggtagatagagctggcctggtagaaaggccaaggaagacatttcaagcagaagaaagtgcacatggtcgggggtgagtgaggcatggaggataaggagaggagtgcttggggatgagtgtggaaggaaaggctgaggcccaaagaaaagggccttgaatgcagtgctaaaaattttttgccttttaaaaatggaagccaacccaagtttattaaaattgtttgcagattgtagtgtcacaccgaaatttgcaactaaagacaatagcattgtggtgcagaggatgatagacagggagagagactagatacaaggagattgggttggaggtccatggtagtcaagtgagacccagtgaagggacccagcaatggaaacacagatgagagggcagattggacagatggttgggagatctgtttgatgtgacatcgtgatccctaagtatgagggatgatactttgttctgtgaagttcccaatcttttgaagtcatttttgctttgttcttttaaaatgaaatcttcctaaatctatcattttctctagttatataggtattttgtttctctgtataagagtattactcaatataaaagttttttcaaggacagagctttcttcagtcatttttttctgggccccccagtcctctggtggctattcaatcagtattttaaaaattgaatcatggtgtcctattcatagtttcagcttagttttgagacgtaatgtaacagatgtaattttacttgaaaatattattgcatgttttattgaattttatttttagattgtaattaaaaacaataaaaatgccttttgattatccttaaagttgacagccttattcttttgagggaggttttgggttttaaagataaccaaaggacactcaaaaaccgtttctgttagttaataaaataatactcttttagtccaaaagcaagttttgaatacagtatttcttttcttttattgttcttaaactgatcctgaaggaaaattgttagttaacaatcaatcagatgtattatgggtgcccttgaaaataatcacttgaggactgtacttaatgtaaaaaaatacattttataagcatatcagtatgtaagtacattcttctagtaggtaaaggcttaatcatttactgtatgctaacatattatactaccacagtacaccatactgtactgtacccaacgtaatgtaccatgccgtgcagtaccgtatcattctaggtatcaacaagtaactatggtagcaatactccagtagttttgaggttgaatatgattctggtttgaacatgttaagttgaggttcttatgagatacctaggtgtacatgtattcatttattagctagattatattcaggttttttagtggcaaagatgtacattatggcaaatgtgtataatttagggtccaattaaggatagcatattgcatctagtgcatatatcttaagtttctttcaatctattactgtactttttctcttctactttataataacttgttatatagacattgagctggttgctttaagaaaataataatgaagacccagttactttaataaaatatcatttgacttgtttcttgagttactgctagttttagaggaaataatgtgaaattctttaagaagggatataggcaaattgggaagtatatagaggagagtgattagggagataaaagcacatcaaaaagagcaataagaggaactgagattgttttatttgaagaagagatgactcaaagggatatgaaactctattcaaatctacttacttataaccagtaacagtaataataccaaacaatatggaggacttaaaaagtattaggcattgtttgaagtattttaagtatattatctcttctgattctaacagcactccatgaggcagatattattattattattattttggtattgtatggactacaaaactgaggcatagaattgtagagatttttaaggtcaggcctgatataacagcaccagattttcagcttatgcaggctgactccagagtaggcattttaaaataaatatttgtgcaacaatcttgtcctgaacaactgttgtatttaaagcactatgtctagaatccttaaggtatcgggagatgatgagattatggatactgctctcaaaaaaatttacagtccacacgacctaaaggactgttatgtagaaaggaaattatatccatttgaatagtaggacctcaagtgatagaacaaagactggagaagaaatttacaggaatgttcatttggtcttaatttaaggaagatgttaaataagacccattacatgtagcatgatgtttttactactcaggccagttttagtggtcacatcttcttaaggtgtaataggcagcctcagaagttactgtggtcttgctcactggaaatgatacacagacagtttaagggacttgccccagaccacacggcaagaggtgaatgtcagaacctctttgagtacattttaaaataaggactgaaagttggaggagggtggttatcaaggctgccttccttaccatagtattcccagcattaacaaaatccttggcatgtaattggaattcagatgcttcttaaataaatgaaaagcctgttgtagccagcttacagtttgcattaatgcagattattaaagtggaagatcataaatgattttttattaatatttatgtctataatcttaggtttggaaaacattattcattcataataattttaattatatgttacattaccacatttttgacttgtagtgtttttagcatagttcagctacagtgtagcttaataaagaatatgattttttaaaatagcaatgctattatatagcctttacagaacttctaaaaaatgacatgttctctaccaccttaatactgaaactcaaatcttattttttgctacgattattccagctactcttttttgtctatatttcatttctgcctttttatgttgtggtccaagtaactctgagcttttctcatgttgtccattgttgcataaaaatcttccagcatcttaaagcacagcctactcacacaaaaaagtgattgtttgctacagaaaatttcttcaccatcgtaattttttgctacttcaaattcagtaagcattcttacacattatatttattttatattcagtgatgaactatttttatagattccttaaaatttctggttatttatttgataaggaaacatgtactagaaaaaagtacaacacatatattgtgagattaattatgacaatttctagaaagtaacagtctgttcaactcaaatgtttataagaaaattctttctttatttatttatctgtgcatttaggcatgccagaagaatccagggaggatacagaatttcatcataagctaaatatggttaaaaaacagtgtttcaagaatgatattcacaaactggtcctagcagctttgaacagggtatgttgaatataagttttctgtatttatactattaactaaaatattaaatttggagaactaggggcgctttttcagtctaagttttctgttctccgtttgctatgataggaggaagtcatgtggttagagacataagatgacagtggggatgtgggaagtgaaaagatatgtactaagctaagtccagctaagtgtattatcaattatagatgtaggcaagattcttttgattgccagtaacataaatccactctagtttgctcaaccagaaagagaaccaaagagccatatatgcagctagaccttgtgagtcatgctgggtactatggctgctgttttctctttctgtcctctggctacttgtctttcttttctggtctcatagtatatggtttagcccatgaagacataccagtgttaacagtaaagtcttcggctgggcacagtggcccacacctgtaatcccagcactttgggaggctgaggtgggtggatcacgaggtcaggagttcgagagcaacctggccaacatggtgaaaccctgtctctactaaaaatacaaaaattaactgggcatggtggcacgtgcctgtaatcccagctactcaggaggctgaggcaggagaatcgcttgaacccaggaggcagaggttgcagtgagctgagatcacaccactgcactccagcttgggcgacaagagtgagacttcgtctcaaaacaaaaacaaaaacagacaaacaaaaacagtaaagtcttctttgattccctacgctccttttcattgttctccggagaaataacctctgaaatgatttggtatacattgtttccattttttagcatttacatatccatgttcctacattataattaaagtatccataaatcatactgagtatgaaaaagagaagaagggaattacatttaaattgtgtaatgcaaaaagtattggtggaattaagaagttttggaaattttgcataagatgaattggttctttattaaagatgttaagaataaagacataattagtgtgaacatttttataaaaggaggagcctatttaaaataattaatggaaatgattccatgtgatttgatatactttgatgaatgtcataaattaattaaagtggcttccagagagatctcccttaaaaattcattttaaattgaactttatactgtcactcactgcctataatatgtttgagtcatttatactcaaactttaatacaatccttgagtatggcaagaatttatgttgtaatgggttaaatttatcttgagaaatatttgttgaaaataagtatatggaaggaaggggttaggcatttagaagataaataaatatgctttgtactcttctctcctgaatctcataagccggttgttgatggctgttgtgaaaccttggttcttttctttaaacaagagacacacagcagaggagatgcagcatcgagtaatttattgcaaaagaaaaagaatattttgcaagttaagtgaggaatagacacttataccctgacagaattcagggtgggcttactagtaaggatgagacagcgtaaattggcactaggaagactccctttgtgggagttgtacatgatttttcataagtgggtgggaagaagtgttactagtaagcatattctaggttgtcctctgagtgaacatgtgcagtagctgtacatgcttgttcatatatcgcatgtctcataagtatctgaaatctccacccaggggtgtgtgttttactattataatgagcaaagggtcagtctgaggacaaggaaaatcaaaatgtgcatgctccccacgctacctgacttcaaactatactacaaagctacagtaaccaaaacagcatggtactggtaccaaaaaagagatataggccaatggaacagaacagagccctcagaaataatgccgcatatctacaaccatctgatctttgacaaacctgacaaaaacaagaaatggggaaacgattccctatttaataaatggtgctgggaaaactggctagccatatgtagaaagctgaaactggatcccttccttacaccttatacaaaaataaattcaagatggtttaaagacttaaatgttagacctaaaaccataaaaaccctagaagaaaacctaagcaatactattcaggacataggcataggcaaggccttcatgtctaaaacaccaaaagcagtggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatctagaatctacaatgaactccaacaaatttacaagaaagaaaaaacaaccccatcaaaaagtgggcaaaggatatgagcagacacttctcaaaagaagacatttatgcagccaacaggcacatgaaaaaatcctcatcatcattggccatcagagaaatgcaaatcaaaaccacaatgatataccatctcacaccagttagaatggcgatcattaaaaagtcaggaaacaacagatgctggagaggatgtggagaaataggaacacttttacactgttggtgggactgtaaactagttcaaccattgtggaagacagtgtggcgattcctcagggatctagaactagaaataccatttgacccagccatcctgttagtgggtatatacccaaaggattataaatcatgctgctataaagacacttgcacacctatgtttattgtggcactattcacaatagcaaagacttggaaccaacccaaatgtccaacaatgatagactggattaagaaaatgtggcacatatacaccatggaatactaagcagccataaaaaatgatgagttcatgtcctttgtagggacatggatggtactcagcaaagtatgccaaggacaaaaaaccaaacaccatatgttctcactcataagtgggaattgaacaatgagaacacatggacacaggaaggggaacatcacactctggggcctgttgtggggtggggggaggggggatagcatttggagatatacctaatgttaaatgacaagttactgggtgtagcacaccaacatggcacatgtatacatatgtaactaacctgcacgttgtgcacatctaccctaaaacttaaagtataattaaaaaaaaatgtgcatgctccatacaggggcaattccctactggagatagctttgcttaaatgagctggactacaatgcaaatgctgaaacttactatattgacagtaagattgccacagttgccgcgtcctgaggacatggttacttccttttaatacctatcctgtctcattgtgagaggattaacaactgtgcataaaaccagttgttctacatgagcacttaggagggataccagcattgtgaacatagtttaagtacgtagaggagggaacagttaagtttattcatggtgagtgttggtgaaaagtggaagaggtaccaaaacagccgtatagataactggttccagttagccaacattctctaaagttattagagaagcctaagtgaggtgtaacctcagcagtcgggagccaagagagcaagtaagtgctgtgatgtggagaaaatcactttgttccaactgagaagaaatggttgagcactgcttttcccccatgccagtactgacgcacagcctttcacttagcactgattatcgataggggtggggagttaaggtatggggaaacacaagtaacaatattttatttcaaaaacctctccactgtaattcccctaatccttcatcatggttgaggaaaatggctctaaaaaatgagagcaattactgtagctccaaaattctgtgattgcatgtcttactctgaatagcaattacaaagcatcagaggatttaggtccaaatattgcagacacaagaaaatgaattacattttaatacatctaaacttggagagcagagttccaaataaggtagaacttgagattcaactctgatttataaagcagagactaagaagagtatttataaagcgaatccatgtttggatacataaaagtgcaataaaattcaagctgaagttaaaatctctgtctagaacagcgatgttccatttatgcctgatccttttagcttttccacagatgaagactttgtcacctgttccagagagatatatttgttcattattgtttccagagagcaaaatggaaaataaactctgcacattttggccgcatctgtgttttatatgcggtgacactcctgttctcttcagtgaggaaatccagtaaagtaaaaccagtcttctgatgaaatgggcacaaatcaaagaacttgtgagcttcacaaaaaccttgaagcaaaatataccaagcttaaatattgaatgtattgatttcagtagtcaaaaacagagctcatctgcaaaagcaacaacaacaatgacaacaacaaattacatataagtaaaatttaaaaaaggtttacaggatgaatatacagaaaactatgaagcttaggggtagagaggagtagttgaatatatgaaaagatacatcttttttgatgaaggactaaatttttaaaaatgaaaattgatctatgtttatgaaccattagtaaaaataacaatagtattttctggaactaagtaagctagtgtaaaatttgtatgaaaaaattaatacatatgagtaatcaggagaattttaaaaaagagtgttgattcatatggcctaactccaaaagataatcaaatgtattatacaattttagtaattataatggtgtgatactggcactaggggagagagatcagtgccacagaagggtggctcaggaaatagactcaaataaaaatttgtaatgttatgatattcctcgactgcgggaggaaaatagattactcagttacttgtgttggaacaactaactcttcagccatttgggaaaagcaaagaaagctgaatatttatcttactccttttgccaaaacaaattacagatggatgagatttaaagtctataatgaaattggtatatgtacatattaaaagtttcaactataattgttattaacgtaaatgacaacggaacaccttgttggagggaaatttggtaatatctatcaaaattaaaatgccatgttttctgatcagcaatttcattctaagaatttttaatgtagatatacttgctcatgtacataaagattattagacatgaatgttcactgtggcatgattcgtaattaaaaatgtggcaacaaactaaatgcttacatggtaatcattcatgctgtttgccagatatttttatttctccaccttgtggtgattctggcatagtatttagtagttaggttgaagcatgtgactaattttggtcagggagttgtaaatggagggaatagctggtgagacatcttgcggaatactgtctcaggtaccatcgtacctgcagtgtttgagatagtagttgctccatcagtagaggtccctgagggactacaacaagcagagtcccctcctgacctgcaacacatatgtagcatgagcaataatggaacttattatttttgcaccctataaaattttgagaattgttactgcagcttaatttaatctttcctgacaatacaatacctatcaatagagactaatcagataaattataccatttccaaattgtatcatcctgcataaatattaaaaaacaatgaggtgagattcctaatgtgctgctatggaaaaatcttcaattttctatgtgtacgaatgtatttcccaggtattcgttttttccttcctgtatgttgacacattatgcacacttttggatgaaattaatatatttccaccgctttatgtcctctccctcacttttatcacccaattgtagcaaagtatatgtttgcttttatagctttagctatataaaattttctaatagctaagtttgtggttcctggaattaagatatctgaatttaaatctaacactactacctacagactatgcaccctggacaagtacttaatgtcttggttttgttatgtataaaatggagataataactgatttttcacttagagttgttgaatattttataagataattcatgaaaaagtgtcagtataatgcttggcacatagtatgcgctcaataaatgttaatgttattactattagatttaaaagtatcttttgacccctggctatagaagatgaggaaatcagagtatttgcacttctaatatctcctgttttcccacctacttttgttcaataaattaactccacattggcagggtagataatatttatattcagctttctaattatgctttctaagtttgtgtttatcttactcctaccgttatttggaagcagtcttcatctcaagtccttttgttactgttttttcactcatcttttagttgtctgaatttctttagaaaagtttaattccctgaatatttaatgtttatattttgttgttgtttttgcctttatatttggactcctaaaaaaagttttgttggttgtaaaatattgtttttttttccttgaagtgtttgtaggcatttcactgtgttctagtactgaatgttttagtggagaagtctgaggccagcttcatttgtttcttggatatttttgcccagtgctgaaaggattttttctcttgaaatccatccactttattagggtatatctcaatgttagtcctgggatatggtatcctcattctagctatacattcaacttttttcctggaaagttttcttgagttgcatctttatatacatatacatacacgaatacatatacatggtaaagatattaaggataaagataggtgctttataaataccaatttgatataattttggcatgaaaaaaagcctgtggtgcattctgagtttggaagtagaactggatatacttacttattactattgtttttaatacaaaaatggagacagggtctcactatgttgcccaggctggtctcaaactccttgactcaagcaatcctgcctcgacctcccaaagtgctgagattacaaatgtgagccaccgtgaccagcctaaatatctaaatttttctctttcattattttagctctcttctttggggctatcagtcatatgatgttggatctcttttgccttaatcttctaatttttcaaagactaatccagagaccactatctatcaccatgccattactcatagacaagggacatcattccacacatttagcttatttgtcaaaatcagagatgggatttataaaagaaaaagaataaagggagaaaacaaaacacaaattatctgggaatgcgagtctgttttcctttctttggctaatctacttacctagtagctaggaaagaggccagcatgagtatttttccattgagctggctagctcagtcattggagaaaccatttcaatatttatggattctctgaaaaaaacttggagagtaaaaaagcataggtggtaggatgctgccatccttctgttggcatctccagagtttcacttgaaaaacacctcctaagtagacactgataaattgattttaatccctatttgagcaccaatgcaatacattactatttcaagatggagcattagataactaaaggaaattctattgtgggcttgtaaatatcatgatagtcatacctatgtaatacatatatgtatatataaatattaatttttaaacatttacttagctattaaaaatcaaatgctcatatttaaaattattggtttattaatgcaccatcacatgttatcatgtgatactctgaattctctttttgcatagacaaatcagagattacctgctgcaagtcattagtcatcattaacctgtactgaaatggttagagcctaggggagttccaggtaaaaggaccagtaatgagtagaagcttgttagatgtagagatattgaggacagagataggtgctttataaatatcaatttgatataattttagcataaaaataagcctatgatgctctttgagcttgggagtagaagtggatatgtaattttcagggcgtagtataaaatggaaatgcacactccttgtttgaaaattattaacgattttacaagggtgacaacagagcattgaagcaagtgctctgtgagcatgaagccctgtgtgaaatacacacctgtgaagctggccttgcctgccaaacaggaatgctggtactgttaatcaaacagaaagttcagaatgacaatctgacttttttttgtagaagatactaaacttttggccttgaatatctgaatttaagatactggtatcaagccaaaagaaatttgggcttagaacttgaaagatttaaacttgtgctttgacttgtgtgctcacagctctctgtgtcacaatttttttcatctgtacttcgggacaacaatagtgtgtcgacatcacaaaggttttgggaggattaagtaggtgaatacatatgaagttcttaaaagaatgtctggcactgagtgagtgctacctcggttttggcatcgttattgtggtcattgctattgttattatgacttgaagtcatattagtgtatgaaatcccatccatgaatagaagacagaaagaactttgggcagggtttggaggtaaaagaagacattgtaaaggagatgggtaaaggaatgattttaaagactgagaataattaggggagtacgatgtcatggaaattaagggatgataagcaccaattaagttgttattggacttttttctttgaatggttcaaattcagaataataaggaaagaagtctgattatacgaaattaaagggtagggtgactgtggaggtagtgggagttgacttttctgctaataagtttagaaataaaggaaaaatggtagcttgaggaaagagaggagcgattaagggaaagtctctcgttaactcttgtttttcatctctgaggacagcgcttagcccaaggcctgacctgtgatcattactctctcaaggtttattccatggacagagctatctcatttcatgcttataacaaccctacattattagaattgttttagagatgaggaagctgagacacacaccaaaccagccttccaatttcactttgcacaactttgaatttctttatatttcttgaataaaagttccactttttaacttaccacttcttagcagtcattgtctaactgagtaattgttacttcattcatttaatggttctcagattcgcataatttgaacctaaatttaattggcctccaagctgatgtgcttacagaaacagtgacaggaaacaaaaatgtcaagggagactatgtattattaagatgataaatgaaatgatgtccaagctgagcaattaaagtgtgaagtagaaggacacagggtgagaaactgatgcttctcctcagcctctataaaaaagatactgaataaagataattgagaggcattaggggactagactgagaaaggattggaaatctgttcactgagagtacagaaatgaggaagcttggaaggcagaagattttggtcaaagacgtctggcttgaagctatttcagctctttggattatctgtggtggaggccatcacgtctttggagtggaggtaccatgaaactagtgtctgcaaaacatcatctaaatgaaagcaaaattcctgagaaggatggcactataatttttaaaagaaaagctatgagttaagcattcatatcaaggtagatgtttggagtgtattgcttgtgtgtgaaaaggcagagatgaccagaataagagttagaggtatgctgcgttttcttcttggttgatgagtaggatggcctggacaaagaagtgacctctagtaaaataccttcatagtgtcaaatcatctggaggaaattcagattaaagaggttggatgatgtcgtaattaagatcctgggcttttaaggtggacacatttatattcaagtcccaggcccaatgcatattagctctgttacttgagcttttatttctgcatctttaaagtttggcaaacctattacatgaagctgttgaggggataaatgaaataacgcatgcaaagcacttgcagtaaagactaattatcaatattttatttgttaagaggcagcattgcgttttactggtcaagtatgtagactctggggtgaaacatatttggtttggtttcatctctgcaatttatagtttgtgtagactttgagaatagttctcaatcattctaaccctcagtgaattcatcttctaatgggagtgatatcagtatggatttcatgagattatgaaaagaaaatgcctacaaagtatttattacaatgcctggcacagaacaagctctccttaattgtaaaaatgctaactcttattcttcataataaataaaagtaattaatgttatagaaaacaaaatcaaggatactgatttatatttggattacttgatttatattttgtcagtctataactggtcttaactaaggtaagtattaagatctcatttttaacagcgagtattcttttgattttagttcattggaaatcctgggattcagaaatgtggattaaaagtaatttcttctattgtacattttcctgatgcattagagatgttatccctggaaggtgctatggattcagtgcttcacacactgcagatgtatccagatgaccaaggtcagtacaatttgaattcaggatttagaatagatttttgtagggcattagctggtgactggatgtctttaaatatttttcttcagttttgagatttaaaacaattctttttttttattttcctagaaattcagtgtctgggtttaagtcttataggatacttgattacaaagaagaatgtgttcataggaactggacatctgctggcaaaaattctggtttccagcttataccgatttaaggatgttgctgaaatacagactaaagtatgtgcattatcttggaaagaatttgggaacttgtgcgaatttcacttttggagcagtttgtgtaattcccactttgcatgaatggggtattctagttaatggaaaaccatttatccttttgtagtattttaattatacaagcaaagaaaattggattgaatctctaaagatccagtgtttcattatgaaatctctaaagtcagcatggttattcaccatttatcttgcccataaaagttcagagaatgtgctaagaaatcccagctagctgagtttattcgcttagattttagataaatagaatttataaatattccaaagtttgtcactctctgggttttattgcaggttgcttacctttagtaattttgcttgttgatttttttccttgcagtgaaaaaatgtttttaacatttttcatcaagcaaaatttaaaacatgatatataataactgtctttgtaaggaattcaagatactggcctagagttagttcacgggagattaagaataaatttgttttgttttgttttttaattgtagcaaaacaaatagtttttcttcaagagtttctgccttggttgtggagtttgcaactttcataaactacaaaggaattttttttttttttttggagacagggtctcactctgtcacccaggctggagtgtagtggcagatttcagctcactacaacagctgcttcccgagctcaagtgattctcttgcctcagcctcctgagtagctcagactacaggcatgcactcccatgcctggctaatttttgtattttttgtagagatgaggtttcaccatatttcccaggctggtctcaaactccctggtctcaagcaatctgtcctgctcagcctcccaaagtgctgggattacaggtgtgagccaaggtgcccagctgactcaggaaatattttttgtaactggcagcattgaccaggaataaaaatacctggtctctaatctttgcacagacattatcagtaaatgagagaatatgtgtaaagttttttaaaaaattataaagttatgaacatacaaaattcttagattaataacaacaatgtgttttataactgcttttcataatgtgcctcaggctaggctgattaaaccaagataggattgattaaaagtaatcttagggaaagggaaggattttgtgccggtatggaactctcagttactctggattaattcatctaggcataaattttagaatctctatagtagagtttatgaactaaatctggcctgccaacatattttatttgtccagttcagggttttgctttgttttttgagacagagtctcactctgttgcccaggctgtagtgcagtggcgcagtctcagctcacatcaccctccgcctcctgggttcaagcaattctcctgcctcagcctccctagtagctaggactacaagtatgcaccaccatgctcagctaatgtttgtatttttagctgagatggggtttcgccgtgttggccaggctggtctcaaactcctgacctcaagtgattcactcacctcggactcccaaagtgttgggattacaggcatgagccactgcacccggccttcagttcagtgtttaaaagtttttaattcgaatgacgtactttctgcacatttgcatggcctgctctgctgtagcattcacttgttttcagagacctctgctctagaggcaggtggatcacctgtccctcagacatacataaattaaggctactttgcttatcaaatattagtattcgtagatactcagcatcataagagttcgaagtaataattttaatatttagatgacgtaagttaatttaaaatttttttgagatggggtctcactctatggcccaggctagagtgcagtggcacaatctcggttcactgcaacctctgcctcctgggcccatcctcctgggtgggctcaagtgatccacctcagcctcctgagtagctgggactacaggtgcatgcacgggtaattttaaaatattttttataggcacaagattttgccatattgtgcaggctggtcttgaattcctgggctcaagcaatcccacagtgctgagattacaggtgtgagccatggtgtctagccaattttattaatatgtaatattagaggtaataaaacattaaaaagttaagatgatccttggtggctttacccaacctaaataatactaaagtcaaaagcccaatctttcattaaaacatcacatgagtgaagaggacagactctggggatgtgcttaaggtggttctaaaaaagtaacggtgttctttataaataacttattattagaatgtaatcctcagagtgccctcagcgcttctcaactacactcaacataaatgaaatctaggagtccacactagcctttctgagataaacatttcggaagacagcgcaaaaagctgggggatatgctaggctctctagagaacctactgttcaatattataatacaaatttttactctattgacctgtttggatgtgtagttctgctgatccaaccgctttaatcctgtttaatatctgggtttcatcctataactatggctttagacaagcatctttgaaaaccaaatttgagggtattagttctttttcctgctttgctactgaatggtttgttaactagcattttattctctgtgcctgctatatttcttagtcatgagagagagagggagtatttatttacaggataaatactttaaagcaccaacccaatatatctatagttaaatgaacatcctaggtattgtttcatatacaaactctctctgctttatactgtttattcattttgcctgtaattgcttattttattattttttttcttatacttttagggatttcagacaatcttagcaatcctcaaattgtcagcatctttttctaagctgctggtgcatcattcatttgacttagtaatattccatcaaatgtcttccaatatcatggaacaaaaggatcaacaggtacagtgtttttcacttgcatcctaaatgttatgtatttatctgactctaattctcatttccactctttttagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtaaatattcaaggcctcacttttgtctttgctcagtattcttatagaatgtaagagccctgccattgtgtatctcttacttatatcatattattcttcactacagaaatttaccagtttattgcaattgtttgtgtcttgtagtagatttatagaattccagaagtaatagggtcctttaggtgttatccagtctaatctttcatttcatctgtttacttatcttgttaagttgataaataacttttcaaatgtgtcccttagtaggcatctctacaacttagtctccagatacactccacataacacatagttctaatgttttgataattttttaaccatttttttccatggttttagtttctttgcctagaaagttctcccctgagggctaccacacatggctatgcaggctgtggatggcacacttttgtcggtgccattcacagtgacatgagttgctgttggccaaagttgtgtaacactggtctttctttccttctctcttccctcctgaaccatgtaaacatatatctatctgattgttctgctctcccttcaaaatataattcaaattatctttctttaaagccctccccatacctccaaacctccaaacaaaattaagatttacttcttttgtcagtctatgaaaatatatacatatctcttgtatacttggtgagttgtgtgaaaataacagtgtacagtgttcatctttgtatcattcagaatatcgagctcattgctttacatatggtgtgtattcaataaatactaggttcattgcttatatttcagatttgtattatttgtataagtgttagagtttatactagcattcaggtagcactatgtctattttctagaaatttaatatttctaacaaagcaattatgtagtgatttaatacacattattaaataatcaataaagtactatgtttgccaatagtttactttttaaaccttactgtatttaatatccctactgtatttaatatcccacttgcctatggattgaaatcaatttgttgactgttaagattaagttaatactaattagtaatcaacataaaaagaaaaagaatttgtaacccattttcatgcattacgtttatgaattaaaatcacataaacaatctaattatttaaatttagtcaaatttcttttaagcaagcaacaattaaaatagttgctccgctttactaaagataattaaatttttccatcaataatttaatacatttttactgtgcatcttttgcatgcagattattgcattaattttaattgaaaataccgaagaactaaaaagaaacttccccttctaagtccacattaaggaaacaacatacctaaaagcacctgatacaactgtactacattccccacaggaaatcatttctactattctttcaatttatccaaatctttctacccaacaggatttttactttattcctctttccatattcttttggacttcatatgcttagttttatcttttctttttaaaacgaaatcttaaatccaaggattatgtattaggtttaaagaatttatcccagttgtcagaggttatttatatctagcaaacaataactgctgattaaatcttgtggatgagtttgtcgtatgtaccttatttgtgccagagcaaaataaggtaatcaggactatttattcatttaccaagaggttacatattgaaggactatctagagcaagggtggagttgtgttagactttctgcagagaatttgataatggaatgtacatgattggtagagaagaatatggaagtttaatactgggtatgcaaatgcatggataaaaacctcaaggtaaaactcatcaaatcacagtggaaaaagtatagtgaagtctgaataaaaataataagaggctgggcatggtggctcacatctgtaatcccaacactttgggatgttgaggtgggaggatcacttgagccaggagttcgagaccaacttgagaaacatagtgagactccatttctacaaaacaaaccaacaagcaaaaaaccatgtatgatggcacacacatgtagtcctagcttcatgcagggtggctcatgcctgtaatcccagggctttgggaagtcaaggcgggaggatcatttgagcccaggagttcaagaccagcctgggcaacatagttagacccccatgtctacaaaaagtcaaaaaattagctgggtatggtggtacctgcttatagtcccagctacttgggagtctgaggtgggaggatgacttgagcctgggaggttgaggctgcagttagctgagattgcaccattgcactccagcctaggcaacagagccagaccctgttaaaataaaataaaataaaataaaataaaataaaataaaataatataataaggctgaggtgggaggatcacttgagcctaggaggtcaaggctgcaggagctaagattgtgccactgtacagcagccttggtgacagagggagactctgtctcaaaaccaaccggtcgggtgcggtggctcacgcctgtaatcccagcactttgggaggccgaggtgggtggatcatgaggtcaggagatcgagaccatcctggctaacccggtgaaaccttgtttctactaaaaaaatacaaaaaattagccaggcgtggtggcaggtgcctgtagtcccagctacttgggaggctgaggcaggagaatggcgtgaacctggaaggcggagcttgcagtgagcctagatcgcgccactgcactgcagcctgggcgacagagtgagactccgtctcaaaaaaaaaaaaaacaaaaaacgaaccaaccaaccaaccaacaaaacaaacaaacaaaaaaccaacaaaaccaaacacttctatcatgctcattaccacctgggcactgctccaaatactttacacaatttaatccttacgacaacctacgaaaaggtccagtaggttctaatgttattcccattgtgcaagtgagaagctgaggcactgagggtttaaataacttgcctaagaacaagctcctggtaacagtgtgaaatctgcctccacagtgcctgctttaatttcttggctacacagcagattcatggtagtggtggtagtggtgttcattttctctaaaataacagtttgaataatttggttttgataatgcactgcatttattataaattagatgatcagagaaagattgcagggataagaaattatgcttttgataatctttagttatattcttaattttcttcattattatttaaatgtaaaaataaatatctgtgagcagtagtattttcctgtcatgaagctgaaattactttcataaatatgtgtgaatattctaaagagaatgactctgtaggatttaaagaaattaattcttatttttgctggcatttatttattttatcagattcactttctcatatatgtctctcttcatggcaccatatgcctaaagtcagcttggatagtttggatcctccaaggaaaattccttccacaaacatgtgcagcacacagtgctagataattaatagagaatataaaatgggtttcctgtttcaagatggtttgtaggtctgtatgtgtagggcattgacaagagagtaaaacataaatcaccttagtacaaagtaaggagtgaatggcatatcttagagaaaaaaaagttactgggctataagagaaggcatttgtgagtttttccctccctccccgcttcccttcccttcccttcccttcccttcccttcccttcccttcccttcccttcccttcccttcccttcccttcccttctcttccctcccctccccttctcttccctcccctcccctcccctcccctcccctcccttctcctttctcttccccttccccttcctcttccccttccccttctccttccttccttccttccttcctcttccacctgccttccttttaattttgctatgagcccttaaagaggattttagtaatttgctacttaaattaaatatatttgctagatgttgtgctaggcttcaggaatacaagttggattgcagtaatgtaaagccctttgcattctagcaagaaaacagatgggtatgtatgtttgctcagtgctacattaaatgaaatggatgggagccgggaggagaaatggtgtgtttggcctgagaggttagtagcaaggacttctctgcaagaaagtttgaagccaattcttcaagaatgaacacctttttgctgggtgaaaagtagaggaaggcatttggggtaatagaaatagcataaaaggtaatgaggtttgaaaaattacatgctgtgtttggaagaatgtcctggagcagcagcgttttagaaggtttttaaagacgatggtgacttgatcagagctctgtagtgctttgaggatgggttgaaggtgggcgtacttggagactggtgggcatttaattggtgccttccaaccacataaatgaatgtcccctcaaatcccttggaaacactttaattctagaaaattcaaaaattgtccccaacatctttttcctctgagttggtaccctggatctttgggtcttcttttctttccttttttgatgttttattttgggtaatgaaagtcacacaggttttgaagccagcagatttggcttcaaatccaagtctcagttgcttgctagctgtaagggacaaattatatatcttttctaaatactcatctataaaatgggagtaataattgctatggcataggatttttttaaaaaaaagattagaaatcatgtgtgtacagaatttagcacagtaactgatggatattatttctattacctgttatcttggtcttctagttgatagctccttgctagcgtctagctcctttccatagctcttcctgagtagggccagcatgcagtgccacagcttgctaaggcttctcctggattgctgagttgttctagtttttgtggcacctcacatgctaacccaccctgaacacatgctctgaaaacataacatttagaggaaggttgaagactgagagacaaggtatatctttgaggaaattcagatgcttgtcttgaggagctcaggaaagctagacacgagtaatgactgtcgtttgtgtgtggcattaataaattttacaatagctatgtccccatttagttattctatgtcacaaataaaggcaggacagtagtatttactgtgttaaggtactggtttcccaggtatcttacagtgagaagacagaagctcagaaagtgtaagcaatgtgcatatttggtggagtctggatgtaaacagagatcttgatgccaagcctgtggagctttgtctccatataatgttgtctctttcataataactgactgtcatgtggcagattattcatgctattctgacattgatggcattaatatcatcttattttcccaatctattcaaggatcagttttgccttattttattttgtttcattccaaattggagatgtagagaaaaatcacatgaagtttgatttgccagtctcctaaaaggaagaaaaatgtagatttttaatatacttaattttttttctttaataggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaagtaagtaacaaggagaatattttttacaattcttatttttaatagtatttttttaagtcactagtcttttagtggttattcatgccagtttgagggaccttaagccaaagatattgcaaaggtttggattttttttttttttggctatgaaatacttcaaaatgacatttaagttctttatgagatagcaaatagttatttataaaaatagagcaaaatagtggaagctttttgaaggggtactttttaatatatattttttattattaaagtaagatatccctgtttttaaaggaaatataaaattataaaaaagaaaataaaaataacttattttatctcttataagtaattaatatggatatttttcctaactttttatatgcttacatgtacctatgcattcaaatgtatgtaaaagcatacacacatatttatttggcatttttaacttagaatatactttatatttcaattgataatgcattttctttatactttcaagctcatgtgtattttgtacatattatgtgtattgatggtaagttaccatcttctgacactatttttatcttttgagctctctcatttgttcacactaaatgtgtttttagcgtgaaagctcccagctttccctgtgttaacttagtcccatgcccatctccttccccatggtcatcaaactccatgaatcaacaccttaaggaccatcttgcaagtaacatgtttgcttctctcatttttatgatgcactcactagcaaaacaccagttttggtcagtctaccagtctactttttccctcagtttcaccaagaaaactgagtgctgctagagaaaagtacccatccatgcaatttggtgcctttatacatcaaggtttccaaccgctcagtaggctccaaaagttccaatcaggctgaattttcctcggtttctcaaacacttcgtgtacccttacttccagtctttttccagtgttactctctctctacctagctctaaattctctcttcacctggctgtctcttcattcttcctgtctcagtgctatcaccagtctggaaggttctcttacatgaccctatagcactttatttctcacatatactaccattcaccacattatataatttaatttttcatttttataatctactttttggtaaattgttagtaccatgaagtcaatgtcaattttgttcatggttgtaaccttaccattgatactagtgttttgcacatagtagattatcatttagaattaagtattcaatattggcaaaaaataaaaattgtgtaatacattatgttgataagcatgtgtggaaacatgcttcatatattgatatgaatttaaattgtcctcttttgaggacaatttggcaatatctactaatatttttaatatatgtacatacttttttgacctcacaatgtactgttaggaatctatgatacagacattctcaatgtgcacaaaaattatgtacaaaaatgcacattaaaacattgtttataatagcaaaagagtaggaaaaaaacctaagtattccccaaaaggaactattcaaataaataatggtacatacatgttgtggaatgctttgcaatcattgaggaaaaaaaaacgtggagcaaatttaatgtcctgataaagattacattactccgtggcaaaaaaaagggcacagacagtgtttttactatgctaatgttgatgaaaatgcaactggaatatgatagttataaaagtttgaatatgaaataaaaccctccagaaatgggttccctggttgtctctgggtctttggaaattactgagacatggttagatcccatgtttcattacttaaactagtcttatgccaaaaacctgcttactttaatcttcaatatccgatggagaggaattgtgggcccattggagagggacagagggagatttatcattcactatattctctttgttctgtctggagtttttaccattgacacatcttacccagttaaaaaaacatagaattgtcatttgattaattggagggtataaccatgatttcactggcagctggtctgagtaaagaacactttgggtcatagctttcaaacatttttcaggtagtatttgcctaagtgacatatttgtgtgtgagctcatcctaccgggcttcgggataatttcccatatcataacatattactctggaaaaaggaaccatttgggtatatgggtatagtgtaagccatagtatcagttgccttcttggggtttatcatatgggtccaccacatatttacagtaggaatagatgtagatacatgagcatacttcactctgctactataattattgctattcctactgttgtcaaagtcttttagctgattatctacacttcacaggggtaatatcaaatgatcccccaccatgctctgagccccagggtttattttcctttttacagtaggaggcctaaccagcattgtattagccaactcatcactggatattgtactacatgatacagcagtatcatgtagtaatatttgaagtcattacagtagtaatatttgaagaaatcttcctggctgtatgtagaacaatgaggactcagccaacttattcttcatagtagagctaatacataatgtaatgaagttgtgagaagaatgttaactttgaaattccatcaggtttcccaatagtcataatgaatcactcagcaaactttataaaaataacaagatcctttatttagcagtttatgtgttctatgcattgtgctaaacattttatatgcatcatttcaattactctttttcatcaccatatactgtatttattatcatcttcattttccaggtgaggacactgatacccagggagctcatataactcacaaatggcatttctatgacttgaacacaggcctgtctggcttcaaagcctaggccttttcctgaataaagttagttccatagagattcagttttgctgtctacatgaaagcattgtgtacatggttatgtttttttaaaaaatatatgatctgccacctgttaattattcaggatcactagtgtaaggtgactttgaaaggaaaaatagaaatattctccagaagcatagcaatacgtaagaactttggtcctatgtatgtttatttttgcataattgttgatttctaagttgctggtgtatctcttattttcagatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggtatttattataaaaaaaaaccctttatgctttatatttacacactgacattgaacaataggacccaagacaaaaacctgacctaaatcatctggaaaaacttgagtagaaatgtgtttattatcgcaaacagttaagtttactaattttggttaaagtgatgggtcaaggaagtgtgtctctgtgcttctaaatgttatactaattggttaatggttaatattccaggaaacaaactctgactagactggaacgagattccacgctctgtcattgactagatcctttcgtggcttgtgtaagccccttaaccttgttaaaggtagtaatgtcgactttgcagggttatacataataattagaaaaaatgtatgtaaaatgtctgcaacaatgcttggcaaacaggaagcgcttaataaaaaaggtttttatctttactatagcttaaaacaatattaatattttaatagctcacttgagataactttttaaaaaattaatatggtgaaatatataatgacaatgattagggctgatgtatttagcattagcagtttggtaaaaatggagtgaggggctttcttattaatatagtatgattgaaaacactgggtgatagaataaggatatttgagagggcaaaaaatgagagttgttccaaaatattgtgtctcaagtcaaaccatttttaaaaatcaagtgtagtgatttatatacatatataatttatataaaataaaatgcattcactttaagtatatattttcatgcgctttgaaaattaacatattcatgtggtcattgtcgctattaagttatgcaatattttcattatccaaaaaagtttcttcatgcctcttcactgaaaacatccccttcccctggcccccctgacccttagcaatcatttgcttcctgacaatgtagattaatgttttctctagttttatatacataggatcatacagtgagtactcttttgtgtctgttttccaaaatgattgtactatgttctacccccaccagcagtacatgagcattctggttgctctacatccttgtcagtacttggtattttcaagttacttttagctgttctagtggaggtttaattcatttagatgtaattttcatttccctgatgactaattatgtagaggatgttttcatgttcttattggccattcttatttttgtgtgaagtgttgaagtattttgcttttaattgggttgtcttattatataagagttctttgtatattctagatagaagttgtgacaggtatatgtattgcatatttttttcccagtcatagcttgtcttttcattttactaattctatttttaacaaaacagaggttttaaatcttggtgaaatgcagttttccagtttttttcttttatggtttgtgctttttgtatcccacttaagaaaccttttcttagcctaaatttgtgaatattttctcccatattttctcttagaagtgttaaaatctcagctttggcatttaggtctaaaacattttaagttgatttttgtgtgtggtgtgtcaatgaagagttgacatttatttctttctgtatggatatccagttgttccaacattacttgttgaaaatattatataattcctcattgaattaatggaagctttgttctctttaattgactatttaggtatggttctattttagcattatttattctgtgccactgatttataccttattcttatgccaataccacactgtcttgattactctagcttaatagcagttcttgaaatcagatagtgtaagtcctctggtgttcttttaaaaaaaattgttcttattattctaggttctttgcatttccatataaatttttaatcaactaactttatgctgggatttttattgtaattaagtccatatttagattttatatagaatttatttataaattaaatcatattacctatgattttaatgtaatctataatatataattaatacataaataataatttatatagattatatctataaattaatttgagggaactaatatattaataatgagtcttttgacatattaatgtgatatatagttcaattagtcttttaaaatttctaacagtgtgttgtattggatgttttctgatactattatagatggtattgtatttgaattctaatttccagtagttcactgttgatatatagaaacataattcatttatttgtacatgaattttgtatcctgtaaacttactaagctcacttacgtgttccagtaccttattatagattctacaggattttctttgttcacaattataccatttggtaataaagacagatttgctttttcttttctaatatttatgtcttctttttttttcttgtcctattgcactggctaggacctccagtactatgttgaatagaattggtcagactgggcatcattccctggtttccaaacttagaggaaaaacatacagtctctaatcactaattatgacattatctgtagtttttcatagatgcccttcatcaaattgaagaagcttcttcctagtcatttttggagagcctttttttatcattaataggtgttgaaaaatgctcttcagcatctgctgaggtattcatatttttcacctttattttgttaatatggtcaaatacactgactgattttctaatgttaaaccaacttgcattcctggagtaaatctcacttggttatggtacattatcctttttatatagtattaaattttgttttctaaattttgttaagaattttgcatctgtgagagatattagtctgtagttttatacttccttgtaattatgggagtaatgctggcctcttgaaatgaattgggaagtgtttcccattccacaattttctggaagaatttgtgtaaaggtattttcttcttaaatgtctgatagacttcaccagcaaaggccatctaggttttaaatttttgtgaggaggagatttagaattatgaatttaataactttgatagatgtatgattattttaattttcttttacttcttaagtcagttttagtaatgtgtaactttcaaggaatatgcccatttcatataagttgccaaatttatttgtttaatgttacttatagcaattatttaattatcctgttagtgatttaattatcctgttaatctcttcaaagaatcagatttttgttatattgattttctctattgtttgtgttactttctcacggacttttgttcttatctttattgttcccttttccttacttatttttattttaattgactctttttatagattcttaatttggaagcttagaacactggtttttagaaccttcttattttgtaacagaaacatttatttaaggctgtatatgtccttataaatatcactttcactgcatcccaatattttgatgtgtcctctttctattcatttaaaaaaatttaatttcccaaatgtccaacaatgatagactggattaagaaaatgtggcacatgtacaccatggaatactatgcagccataaaaaatgatgagttcatgtcctttgtagggacatggatgaagctggaaaccatcgttctcagcaaactattgcaaggacaaaaaaccaaacaccgcatgttctcactcataggtgggaattgaacaatgagaacacttggacacaggaaggggaacatcacacaccagggcctgttgtggggtggggggaagggggagggatagcattaggagatacacctaatgtaaatgaggagttaatgggtgcagcacaccagcatggcacatgtatacatatgtaacaaacctgcatgttgtgcatgtgtaccctagaacttaaagtataataaaatatatatatatatatataaatttaatttcctttgtgacttctttgattcacgagttatttagaaggctgtcatttattttccaaatatttggagattttctggataactttctggttattggtttcagtttgacttttttgtgctcagataacctactctgatgatttctatccttttatatttattgaaacatgctttatggattatcatatggtctgtcttggtgatgtgccatgtgcaactgaaaagaaagtatattcagctgttattgggtcaaatcaataggccaaattgtttggtaggatttctcaagttttctgtgacttcactgacttttctttctatttattgtatttgatagagaaatattgaagttgtaattgaggatttgttggttgccttttcagttttatctgtttatgctttgtatattttgaagctctgttgtttgttgtgcaaacattaaggactatataacaaaggactatatataaaaataattttttaaataaagtaaccactttatattaatctaagtttgcagttagtatcattttcttcctctggaagaattcccttttacatttctagcgcagatcttccagaaacccatatgcagattactggagcactttttccataactgccccagaactcccagctatctcagtctccataaatgttgatctctatctcctcatctcaggaaagccatgagactgtttaaatttcttcttatgtatatggcccttaatttgtctctaagcagaaggccagagtgatcatagggctcacataatttgtttcccttctttcgggtattacatagtcctatgctgtctgttgcccagtgtctgtatccagtcatttaatatatttatccagttttcttgttgtttatgtgagtaggttaagttcacatttgttactctatcatgcctgaaagaactctcttcaagtatttttcaagaaaacattagaaattttaacataaaataattataaaatgcactatgctgcttgtacaaataatgtgctaatagacatttcacacacatataaagtgggataattatgataatttaataatctttataattatgtaattgttactaaattataaattatattttattaaaattcttaagcattaaaataatttaaactatagaattaattaaactttagcaatgaaccaggcaggaactgtttatatcaggatttatactgaatattataagggtggtatttggatatacagattttataatttggttttgacataaaatgaattctttctttttctaagataaagagtaggggaatttaaaatcataattaatttttcacaaatgcattcacattatttatctttaatatgatttttttattgatctttgttttcttgtaaatttattattttgaaagtactgccttttccttattttataaaacaattattgccagccaaatttattgtgtttattttaataccattccataaaagaaaccatgaaacatgaaattcaaatagaaatttattaaaaattgctgactgttaaataatttgtgtgattacaacatttaaagcaagatttgaaaaatttataagaaaaattcagggagttaatccactctctttcctatgctgctagaccctattccagcggtctccataaaaaaaattcagagaaacagaaagcagtaacagtgatcagattgcatacaaactttctgcacacacatatatttgttataacttatgtaaccgttgattgatttggctttttcctgctggactatgagctcctctgaggaatagatttattttttttctgcatatcagtatcccgtgcttacccagtgtctagtctgtaacagccattctataaatatttatgggtgaagaaaaatgttgttgaatttttaaagtgaaaaaccaacatggcttatcatctctattttaaagattttacaaagggaatggactgtgaaatttccattaataaaaataggtctaatcttccatgattgaactatgatagaaggatcttatgattgagtaagctttttgtattcaccttcatgttattttatcattttcaaaataggaagtgaaggctcatttcttgtgaaaaagaaatctaattcaattagtgtaggagaattttaccgagatgccgtattacagcgttgctcaccaaatttgcaaagacattccaattccttggtaagttaaattgtgcaattgtgattatgttgtgttttgctgctgacattctcttgataactaaaatttatgccaaagctaggaacaattggtagggatttccctgatgtatgaaaactataattttgagatttttatatatgtaatagatatgaaaacatattagatgtaaattatgctcaattcacatttgtagtcttttgagtatgcagggtatgaattttttggggcacatatatatatatatatatacttacagtacacttcaagatggttttcttctttcttttcagaactccatgtctgaaaagagcccaggctagacctctacctaatggtgtgggttggtcccatgaacactttagctagaaatctgatagtgatttctaagaaaccagacagaagtctgaaggacactgaacaagatggagtagcataatataattcattgttcatctatctatctatcatctatctatctatctatctatctatctatctatctatctatctatcatctatctatcaatcatctatctattttggtgtattgaaagtcatttaattttttagatacctttattattatttcaacctcttgtctgttttggaactatggaaggactatggcatatttgcatgaggagtctgataattctagttgaggaaattgggagccaccttattctcaggttcactttgaaagacctgttctaacctattctccaattttgattatagctgagtactaaaaatatgagggttgttttgtgttaattctagatcttaagatgggtgaaatgaatgactgtagttgaatcggttaaattagctgtcagtctttatatgctctttcgaatttatatataaatttagttataaaaagtagtttggttaatgagaaattatatggatatagctttttcactcaacctttctgtttttcagtttccttatatttaaaacaaaggagaaagagtagatgctttctaaggtcatttgagcactgaactggagttttcttttatcctcataattgggttcttagtttttacttgcctattttttcccataattataaataccattaaccctattaaaatttcatggttccttccttataaaaatgtcctcttctccaataaatgacagcaattttattataaattattttttaataggggcccatttttgatcatgaagatttactgaagcgaaaaagaaaaatattatcttcagatgattcactcagtaagtatttggatgtaatcataagtaaatagatattttgggcagaatgcagtgtttggttgaatttcctccaattattcaaatattcttggtgccagtttcatcttacataatcttcatatatatttacctaatgattccttccataagctatagaaaaatgaaacatacatttaaaaatttacctttcttgaatattatagaacacattagtctttttttttacaagttttctgaaatgtaaataacacctccaccaaggccactcttcatcctctcctccagttttctttctttcttttttttttcacaccacttacaccacctgattaaatgctttttatttactgttcatctctgccactggaatgtaaactccatagtttggttttctactgaatcttcagtgccttgaagaaagcctgattgctaggaggtgctcactaaacttttactacatgaatttaaattatttgcttatatttccattgtttgtttgtttttgacaaaagggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaagtaaatttaatttatccttgtaactttcaagacatttgaagagcttttgtatttatatctaatttgcataattaagtcgtttaaaagaacattctacttttgtgtcactgggtgataagtcccccgtgcctctggtttttgcacacatatcttagtctgtgtgatgttcaggagcatctttgagggcaggcaatggaaacagatctgattagaaaggaattccaggttctgtacggagtacatgttaaagtctgtcaagtgtatattgattatactttaatcatttaattcaagtaagacaacttcaacaatttaaattagattaggtaaactagaattagacctggtttggtagtactggctctgactcagctaccaactgtgtgacaatatgaacatgtcactccgcctgctctaatccttcattttctcatctgtgaaatagagattcaactaaatgattactgaaagtttttttttcagtttaaaataatgtgtaacttaaagatttttttctttttggtcaaagttcctgtcttgtaagaattaaagtataacatagtttgttgataggatagctctctgaaaattgactttgctcaccatttgtatgtactacagatcaaaatagttttgaaagccaaagaagatatcataaaagttaaaattattttaatgcaaatgtttaaattgttaaattctcaaggctgggcatggtgactcatgcctataatcccagcactttgggaggctgaggcgggtggatctttttgagttcaggagttcaagaccagcttaagcatcagcaaaatcctgtctctaccaaaaatatgaaaaattagccaggtgtggtggggtgcacctgtggtcccagctacttgggatgctgaggtgggaggattgcctgatcctgggaggcagaggttgcagtgagccaagatcgcaccactgtactctagcctgggcaacagagtgagaccctgtctcaaaaaaaaaaaagtcttgttgcaaatgcatttccccctttttaagcctaaaaaattaatcataattttgagatgttttaaaggcaacattacataaattttaagtatatttaagggatgttttttctctaaagtttttatatctggagacagagagaagaaagaaaggtgacccactcctccagccatgccctaatgtctaaaatgtgtctttctctcttctccacttctttgccttgctaaatacttcaagccacccagggctcaatttaactgtcacttcatcactctctgcttctcttcctttttccttctaccctccagccaacctacccacctagcctccatgtccataacacctgatgctttccacctaattctcattcggtcatccaatttgatttaaaatacctttgcccccactagactgtgaactctttgaggacaggacttgtttcaggcttgtttctgtctattcccagtgcctagtgagatctgacatatggtagaagtttagtacttactgaattgatttgtggaggaataaatgtctgaaacttggtaatccttcaattaatatttgttaaatgagcaagcaaaataattttgggatttagtctagttaaaacaaagagaattggaagagactgtgacaaggtgagacatgccggcattcaatgactggacaagctcagaaccttctcttagggaaatttcaaaatgacaccattagatggcactttgtttgtttgtttgttattgtcaaagggtctcatctatgttccttttataggaacatttcctgattaaaccttgggaataattttaaaatctttacttcagaataagttaatgagggtctgaaacaaaagcaggaattttgaaacaacttctggggctaagagtggttaataagcctctataatgatatcaaactctagagtttctcgtgtggataaatatattgataaataaagaagaccatagagaagtgattgattttggtattttagctctttgagagtattacgtacctaagttttaaaaaattgacataatgtgtaagtaggggtttgctattatcattataaaattagaaattgcttaaaaatagaaagtagaaatttgaaacaaaaagtttcgtaaaaaacaggaggttctaaaatgaaacacattataagtaactatttttatagttaaatcttaaatatatcaaaatatgtaaaatttctgacagcatttaaaacatattcccaggattatattgtactttttgttaaatcattaattcaaatatttgttgaggcgtattctgcttccattttgctctttctggaaataatttacaaaaaagctgaaggaagctttcaactctatttttgtgaacctgctttttacaatctacctgttgtaattttcctggttttacccatgctacaagcagagacgattgggccaattagtatactgaaattctgttgtggattgtgttttcaactttttgaaaattcttgatggttctagttaccagaggtgtgtaaggcagaaatattagctagacttaagttcctcagatggttcactttagaattttaaactattgtcttttcagactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaagggtaagaaagagctcattaaaaataaaagggttgcctaaatatgctgatgttaacaaaatatgctgacatttttatagcaatgagttttaacaacatggtgaaactccatctctactaaaaatacaaaaattagcccagcgtggtggtgcgcaccttataatcccagctactcagaggctgaggcatgagaatcgcttgaacccaggaggcggaggtcgcagtgagccgagatcgtgccattgcactccagcctgggtgacagaggcgagactctgtctcaaagaaatatatatatatatatatataatatatgtattataatatataatacatatattatatatatttattatatataatacctatatattatatatatactatatataatacttattatatatatactatatataatacttattatatatataataaaagaccgaggcaatgaatattacaacttttatcaactgacttacatttttacaactaatttttaaattaatgagtcctctttgatgctgttctttgaaagcaaattgtttttgatattttttctttaaagcatatgaatttatgcaatttaatcattatcttgtctcttgtgactagaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttggtaagtgttctgtgtgggtctcctccttaccaggccctctaagttgtacaagatgagtcatatatggaccctttagttgtggatttaaaagtggcatttcagtttaaatattatgctggatttaaaaaataaaattagcaggttggcaataaaacaaaatgctataaaactatgaaaagacatgaaagaaacataaatgcatattggtaagtgaaagaagccaatctgaaaaggctacatactattcgttcccaactataagacattctggaagagacaaaattatgaggacattaaaaagatcaatggttgtcaggggttaggggagggagagatgaatagataaaggacagaggatttttagggcagtgaaactgttttgtatactatagagggggatatgtgccatggtacacttgtcaaaacccatagaatgtgcagtataaagaatgaaccctgatgtaaactatggactttgagtgataatggtgtgtcaaatattggctcattgattggaacaactgtgccaaactaatgcaaattgttaataataggggaaaatgtgtgtggggtggtggtggtggtgagggaagaagggatttattgaaagtctctggactgtgtgctcaattttcctgtgtatctaaagctgccctaaaaatagtctataatttaaaaaaattatcacatttttattgtcagaggttaaaatgatagttacttggcctactgtgtagtaccctgtggttccctttagtcttaaactaaacatgcacatggctgcctgagctgggtaaggcatcctgatactgagatattgtttttcatactgaagtttcttcagcaactttttgtatgataaatatgattactctttgctgttgttagaaataaaattaatcatttaatggttttcaaattagtgaagttaatgtatattcattcagctcttgtgctttgcaagacattataataatgcaaattattatcatcacttttattaaaagttgtagaatcccctgccttctcttagcatatgaaataatagaggaaattatgttcatttgtatcctaaatgaacattttaattttaaggaacaaaatacttttatgacaataaacaggaattccccatattttatcttccttcatagagaatactcacatcttgccacccatgtgtttattctatacctgactcagtaaaataatttttaattctatttaatagcagaatatggcttaactacttattaatagtattttaatttgtcagagctttcagaaactaataatgatcaaagccatcttaatttggatagtattttcctccttttccgcgccctcccttcctcctaccctcctgaatattggccactttccaaccatgatcttgaaactggggatagagttgttgactcactcactagtaagcaaagcaaactcggtctctgtccttaaggaacttgtgattaagttcagagcacagacaaacattaagtaatgatggcataaataaatgtaattttatattgtggtgccttctgtggaaaagtttcaggatgctctgtggtacctcaggggaatctgattcagactgtggagtcaggaaagcatttctgtgcctgtgacatttaagttgggtctggaaagaggagcatccaaaaggaccttgaagcttgtgtatggtcagtgtgtcatctcagctgaatctcacaatgatcctaatggtcatacctaggacaggtatgacctctgcccaattgaggaaattgaagccgtgagattttttgtgtgatgcttacaggtgcatacaattaattatcttgttgtgaaagtttgaatggaccccagttcaaaatctgtttgctttgcactacacaatcttaatagtttgagaagtggtcttacatttgagaagatgccccatggaggtgacatctgagcaggaccactaaccattaaaaaataatcccatgtaaatggtgaaaccctgtctctactaaaaatacaaaaattagctgggtgtggtggcgtgtgactataatcccagctactcgggaggctgaggcagaagaatcgcttgaaccagggagtcagaggttgcagtgagtggagatcaggccacagcactccagcctggcgacagagcaagactccgtcaatcaatcaatcaaacaatcaataaatcccatgtaaaataaagttttagttctgtggccttatgagtgttttccatacagcatatgaaactcaagactctgaagtcttaagtggagaatcatttcgattcatttattttgcgaataggtgaggtataatagctatctttctgcttctcaggaagacagcttctaggagtgtcctggaacattttgacccttgaagattgtctagataaagaataacccatatttttaaccttgaaaatgctaataactaattcctcaatccgttttcctagaaacggtagatttgtagatctctcaagtgtcttagtgttcatctgatctagctacactcttttacagataagaaaagagactgtgtgattttctgtttcccaaattgtgtttcacagaattttatttcttggaggtacctcatactgcatttccttcttaacaattcataaagtaggccaggcacggtggctcatgcctgtaatcccagcactttgggaggccggggcgggcagatcacaaggtcaggagatggagaccatcctggctaacatggtgaaaccccatctctactaaaaatacagaaaattagctggacatgatggcacctgcctgtaatcccagctactcaggaggctgaggcaggagaatctcttgaacctgggaggcggagattgcattgagctgagatcacgctactgcactccagcctgggcaacagagcgagactctgtctcaaataacaataataataataaaataataaaaaataaaaaaatcataaaatataccagagtattgagaactcagatattttactttattttactgaatgtttcccaatctcttaagattatatgatcgaagaatacttttattaaataacacccattattattccatagaacactctttatgagctagtaccataaagaatttttgtccttataatatactgtattttagtaaagtgttcatagttgttttgctatagttatttaagagtaattctagttaatctatatggtatataataacatcacacataatttgaaatgaatattctaggaatttttactttgtacaaatgttgggtagacaaatttatatttaaatagctgtttagcttccaggttaaaaggttctggtaagtatagcatattattttattgtttagtggaagtattaaggctattaccttatttttaaaagtggatttttaaaaattgtcagtgtgagaatggaaatcaaattaagtgacacactattggtagctgttcttatttttgaatttaatggaaatctggttaaaatgattaaaatgtttatctcattttttttcttttagctgctatgcctttcttgcctccttctatgacaatcctaaaattatctcagaacaaattttcctgtattccagaagcaattttaaatcttccacagtaagtttattgttattttaattttaaaagcacattagctggaacagaacctttagaaacatgatttcgatttagtcatatagaggtaattgatttctaaacctactcaacttgatgtttttgtatgtatgaatgattttcactagataaaagacccaactcattacttaaaatggaaacttttatatttatttagtggatcattgtgtaaaaacaacttaagattgtttaattaattgctgtattagtataatgaaatgagattatactggctatcactttaacttttaaaattttaattgtttgtggaacttgatatgttgccaaaatacccttaactttcacattatgcttaagttatgtttgagtgaaattttgggggaagattaggcaagtttatgtagttccaggtttttgagatattttggttaattcatgaaaccagaagcttcctgttaactttaaattcaggcattaattggatcttgagtgtgttgtaatcttaaatgctattctaattatatcatacatgataaaccaaattcataaaaatatatgtgtaaatttatcttttcctttgttttcttgctgtcagctattccttcaaacactatggctttttagaattgacactaaaatgctgcttgcatgatgctgcaatgagctcttctgtgagcttatatttaggcaaataataattagaatttagccatagagagtgttacacaaacctataatagctaaattacgtctagctttagaatgtgtttaactgttctaactactctacagcggttcatctctttaatcttcctaataatgccctacgatagccactgttattatctccacttcataagagatgaagtaacttgcccagagtcatagttcttaaacactggtggttcaacttcaggctctcaaatcacatgcatactcatatgtcaataatgctagttttgacgttacactttattctcaccctggggaaaattatttgtgatgttatttcatgtattttggaaatactcatttggtttatgtcttttctgtgtattgttttagcttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagaggtaagacgattattgccacttaaaaaatatactttatgatttgcatcattacaaattatcattttaagtgatatttagcttctaaataccaatttcatgaaactagaagcttcctgttaactataaattcctgtcaactataaatccagatttccattaaatttaaaaataagaacagctactaatgatgtgtcacttaatttaatttccattctcacaccgacaatttaaaaaaatctacttttaaaaataaggtagtagccttaatacttccactaaacaataaaacaatatgctatacttatcagaaccttttaatctgaaagctaaacagctagatataaatttgtctacccaacatttgtacaaagtaaaaattattagaatattcatttcaaattatgtgtgatgttatcatataacatattatagattaactcaaattattcttaactgttacttaactatgacaaaacaacttagaacgctttgctaatacacaagatagtataaggataaaaattctttatagtactagctcataaagagtgttctatggaatagtagtggatgtcatttaataactataaattcaaaataagcattgtaaatatcaataccattcaatttttttttgttttttaaacaagttgtaagcctaccctatggtaaatggatatggtaacacagcataatttcctcaaaaaattacttttgtgatatacttttaaaggattatatgaatatatacataattatagatgaatgtgatgctgtgtgtcattgtatcaccaaatctctgtccaatctgttaacagactcttaaataaaccatttttctcaagttgttactggcctgtatactgtattacttgtttttcagctttccttggtacattcttaaatttctgcattccgccaccatgctatcaccctaatggatcaaccttttttgttttgctccattctctctgttgtaaatctgaaattgataatttgtttgtctcagaaaatattatttttcaagttctagcgtattgcctacaaaaaccaaaagaattaagtgtctgacactgtgaggttcagcaaaactgtgcatatattttgctacctgattttttgccagcaaatgagtgttttctattataaatatagtatatattgcttaaaaatttggaacagaaaagaaattactccaattaggatgccacctaaagtataagcatgtagctgtactttgagaacactaaattgcatgcaggtttgtagtgactaggtcttcttgcctttactgaaggagcagaatgaagtcacagataatggataaccaaatccattttgtggtaagaacttccttactttcaatgtcttgaagagatgaagtatgttaccaaaggagattgggttttttaatattacagatgagtgacatagattgtttgggagtaagtttttatatgtaagtttttatgtttttaaacacatactgacaacttatgacaaacctttggaaagttttaaaactctgttgaaaggttgtgcaagctgctgatggaatctgtgagcctttcttgtttcttatcacgttttttggcagagcacatttcttccttcccaccaacaggttttgcccttttttttcccattaagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggttagataatttttttctatttggttttactaaatttatttcagattttctactctctgtgactttgatggacatatattgttactatttagggaaaaataaatagtaatatttggcattaatatgctgtgtgtcatttgcctttcatttaatgaatgtgtttctgtggtgccactgtagagatttctcattcttcttagccagactaatgttgagagcggcttctcctccttctgtttcttttcagtggagtagactctaaaagaaaataagtattgctatttggtctctggttaccaattacacaatctaaagaaatacagcacagtataataacttctcacactgtatttcatatagcaactagttaacatatgcctcttacatcttaaagcattatagctactgacatcatgtgaaattactaacttctattttgcccattaggatgagtaatctactcaccttgatcagttttgaaagcaccaaaacttctcaagtatcactgtttctggtctttacactttaagcactttaaatatctttggtaatggattttatcctcctttttgttccctttcagcacatcggtcttattactttctcataaaatcctttgctcccttttccacagttactgtattaacgttgcagacctcagctctgtcatcacctctcaacttgactgtaatatccaccaaggcagagaccatggctgtgttcactcactattcaaatcttggcacccaacacagtgcctggcatacaattaatagttgtttaattaccagtgatttatacttactcattctcttctgcctaaaatctcttaaatttatatttaacttcatctgtttttatgaggaaggattttgttttctgaactcctgagcttgatttcattttaaaggagtttgttatcttttgtgctaattgtggctacccttcatcctacccaattatttttctctcttgaaactggaaaagatggtcatataaaaattggttcagttcttactaaacatttagtagaactagctttcagtgtattatactgtattatctaactaaatatttttaatatttaatatttaatttaatatataactaaatatttttaaacatgtttaacattttcagaaaagacagaaagacctagagcagattagaaattgtaggcatcatttgctttttgaagaaagacattttttcaaatagtggtgcattcttaagaaataaatcaagaaaggtaatgttgctttttggtcatatcatcaggaatgttggtcagattcttattagttacaggaatgaattgatcactactctgatgtaaaattcacttatgatttagtctttttctctaatttgaaactgtggcaacattttaacatatttcaaaatatatctttctctatccattatatttttgataacactttgactctactattagtttaaaggtggttttttagctacctaaacacttctatttcattcaggttttacattaagatcattaggaatgaaagctaacatctgctgatagtataatagtttatatttatttatgatgttatgtgatctcactatccatatatactattatatgcatatgtgatatacatgaatatatagctatacatcatatataccatatatgaatatatacacacacatatataatgtaactaatatgaccctattatcaagctttaacagtatacatatatctctaccttgtttctatgtcatatggactttgtgaaattttgaactttataatttatagggtttttcttttcttttcttttctttttttttttttttttgagactgagtttcactcttgtcacccaggctggagtgcagtggcctgatcttggctcactgcaacctctgcctcttggcttcaggcgattctcctgcctcaacctcccaagtagctggaattacaggcacctgccactgttcccggctactttttggatttttaatagagacggggtttcactatattggccaggctggtctcaaactcctgacctcatgatccgcccacctcggcctcccaaaatgcagggattacaggtgcgagccaccgcacctggcgtataatttgtagggtttttcatactatttaaagacattagaatatgtatacatgtatgtatatgtgtgtatatatagaggtatatatatattgcatatcgtattctaattagtattgcaaacatattttggccttttgattatttctggtgatagtgtaacatgttttctttggtgattttaccaaacattatcaactaccctaaaatctctagcaaaatatatgcattaacagtactctgaaagacatgtacattattagttatatgagatatgcactcttctggatactatattttagaatagtgtgacatgtaaaagaactcacctaaatctcaagtatacttttaagcagtttattattttatttttatctttcaaatactaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtatttctttctatagaattttaaaattcacttttaccatttgtttggaacagggattcaaaaactgagctttctgttctaatatccagaaacctggtagactgtatggaattattccaaagcccttcatttctcctaattttacccttgcctccagaatggagaagaacatggagggatatgttaggaacaatttggtgctaggtactttgatcggttgctgacaaatatgctaaaagtggtcaatcctagtaaaaacccagaatagttctctaaacatggtctgttgtttttctcttattagtatgctaaataataaatagtattattctcccagatttttttttaaaaaaggattcttgcctgtcgtttgaaagattaaaaaaatttgtctctaatctttatttaggtcgtgaggaattctatagtactcatccccattttatgacgcagcgagcattgtaccttgctgtctatgacctcagcaagggacaggctgaagttgatgccatgaagccttggctcttcaatataaaggtgatttgttctgatcatttgaaaatagaaaataattcatgtgtctgtgtgcgtgtgtgtgtgtgtgtgtaagttaatttattttgggcaaacaattgcttcagtctctttaaatactttcttaaaagaagcactaaaattttgaattgggaaactttccgagtaatgaagtcataacatgaaaattgtatgttccatgttggtgaatgttattggtaacctgaaactcttttatgctgtaaaacttgaaaatatatatgttcaactgttttttaattatattatttcttaaatgaaatctaaatttttctaatttaaaataagctatattaaagaaaagcaatctatatatatatatctcatcaactttgtactcaggggccatttagtgtgaaattcttcagattgtatcctttaagtggtcccagattattatgctgttacatctggaatctcccttttgttgcttttctatcttttcctttgttgtcttgttgtcagctattccttcaaacactatggctttttagaatggagactaaactgctgcttgcatgatgctgcaatgaactcttctgtgcataaagtccttaaaaagcttgtgtcaggacatttaaccatgtaattggctgcatacatgcttgttttgtaatttgggtattttttaatgtttcttttattaacttttttacagctagccaacgtgagcaaatagtacagtggcagtcatatttgcttgagtggcttttattctttcattgtagactccaaattggttgactttaaaacgaatttagaagattaaattcacagataaggaagagaaaatataaactatatgacgttaatttgatataatttgtgggtttatgaaatgcttattttatttaggagtgaataactcatcttaaggcatgaagatgggaaaggaaaactataccactaccgttatatatgccacctaaaagggtgaagaattgggttaagaaaggccaaaaatgactttttaaaatgtcgtaaggttacatttttttcttaggtttaaggaaaaaaggacagttgttcttttcttcttctgaagtctgctagtttctcttttccattcaagtgaatgtcacggaaagcaaatatcaacaggaatgtgagcaggcccagtttgaaagcaaacacaagagggttttgtgtctttccctccaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaaggtaacatggtaggctggtagagaaatgtaatttattgattctcaactgcctagaaatgtcagaaattttgagaagtgagcaactcacttaaaattgtgggttttctttccttgttgctgttagcattattaaagtcctttccattttaaaattatttatgccagacttcatttctaattcatagaaatgggaacaaaaaataattagaggaacctgagagaaactaagagaccgtttctgggatactgagaaaatgtttctgagagagaatctgagaaaatgtttttgatgccttttctgattcaacttcttatagtggtgattcaatcacaagggtaaaggtgaatactgaggtcttgggatcatctttcttctattattctttaactgttatttttccatttcctcttttcttttggaattcctgttttatggacatcttgatcttttgtgccactcattcatgaattttgtcactgtgattcccattccaatttttttccctccgtattgtgaggcagctgttttatttagtcatgaagaccactaacttggttttcagcagtgtctcactaattacttagttcatacaaaatgggctttttattttaggaattatgttttaaatgtttaaagttatcttctcgtaagccaaatttttataaaatgtaaataaatcagttatcagagagaacacttttttttttaaatacttggcagaaaaaagaaatcttcactgggtactacagggagtgtggtgtaaactgtactgaaaaatacccttgatagttccatatgacaaacataatgatgaatttcacttagtctgtcttggcttagctcaatagcactaatgatcaagatactggctgataaatagagtcctatttggcctgggcagtcccagcataattatgtaatagtgtcccactatattctcaaaagcattccaatttggatgataaattatatagtcaccttggttataactccatgctggccagttagcttagttctgttccatttatatagattatgtgtgcttcactccaaaacctaatgagccatttgtaaaagtgatggcttttgcggtgcccagggagagaatttgtatgtttgtatccttcaacacacatttattacagttattaaaaggttttattgatgatagatggtaatgtcatgtaaaaatgacatattatttatttgtagactttcctattctcttgttggacatgtaattagaaactaatatgacttaaagaaaaacaaatacacaaaatttattcatccaattaatctcttaatccaggtgttttttttttctgagactatacccatacttcaataactttgttgttactgagaatattttgagtttccctttttgtcattgttgtcagagaatgtatcatatctttaaaaagacttgttggaggatgagtttgttttgaaaaggcctgaatttagttgatgcaaagtcacagataagatggttcattaagctgtattaatactgcttttgtctaatagatatcattaccaataagtcagactagtttttcttttggcacttataaatcacctttgaagacaactttttacaaggaaataaaacaaatgctttgagaaataccagtattattgaaagaaaagtatatattgctaatggatgcagcattctggcataatggtttgaaaactcatttgattgctttgtagaagaatgactctttcagatgacccagggcctgtgagcctgccagaacttgaaaattctttcttccctgaggtgcttcaacctgaattcaaagagcagcttttaatctattagagatcattttttgtcctctcatttatttttcatatttgcctttgatcttagctcttctctaatctttttctgtctcaaccttattaacaggtgtctgtgcagacacttttaagttttgttttttggctcagcctgtcagttaactgataatcatgctgaaaggagaagcaggacaaaacagagttcaatgctgacaatactccttttaatcttgtccagcccattagcagagcaggcatctctgtgggccttgagacgtagtcccgtaaaactcatcccgtttctacttgatttgctttctttgagaactcttgtttatttttatatggaggtttcctgccttggattaaaacataaacctcaatctgaagttcaatttcatcttaatttatgaacgactaagagagggaacatgaaaagtggaggttagtgaaattatctctaattctctgggttaagagatacatgaaaacagtctcttgagtaaccatttgcaggtaaatatggaagtaatggttatggttgtctctttaagtttttagtcacaagtagaaaaagaccaagttaatttttttctgtgtgtgctgaatttctatttgtagtaagtgtaagaatttaagcagaaattctgattcgtattttcagataaaaagaatatgtaatttccataggtccagaaatagggagagtttgccatctggtggttcttaacggcactctggatattattaagagttgcatttctatttaaaattatattttaaaaaacgtttggaagatacttttattgtagaaactatcctcttagggccattctttaaaaaaatcttattttatatatttctcattttgttgatagtgattagattctaagagcaacagaacaatgatcatcctctcctatcagaatcactgatgtttagatgatttctcattttcccaagttcaaggttccatgaaaaacatagcttgagtgggattttatgtctctgcgtttcactgttgatatatatgtcctcccaatataacattttacaaataaccaagcacaaaatttaatattttaccttgaatatttaaaatataataatatccaaaagctcttgtaatttgtactgatatcttatactagcgtgtctgtttcacattaagtttaatgtcttaggatataaaaaatcttttttatggttagtgatttatcttgtttttttttccatggaatttctggatagcgagataaatatttccatactattttatttgatatttccaaatttgcctctgaatcaacaattttcctattttaatttcattgtacttgttccttacaacctaaatagctttttattatattttgattttatttaaaaatgtacttctgaataatatatctgtttctgtaaaaactgttagcactgaatttgccaaccatttgacaaatacacaaataaaatagatttttacggcttgtcatttgtaatttcatagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggtttgtgtttttcgttccttattttcaaagctcagctgtagtaacttataaaagtgtttctgaatcttttatagaatttacattcaaagttgagagaatatccatacggttctttaataggccactgatttttttctttttggaagatcatcatgtgtgttcatgacaaatcatgtatcatgtcataagaaaacaaatttagaaatcacctaggagtaaagcagtggaaagagtccctgagtgggagttaaaatatttgggttctagaacttgtctttactattcaggagctgtggaaccctgaatagtcaaatgacattcataatgtcaaatgagtttagtgcatgtgaaagttatttttatattgcaaaggggaattattgttggcatggtctaactgggacgcttggagagtcaatggctccctgagatgatgcagcttctgagtggaagatctagctctcttgcatcaaatattgatctcaaagatgaaaattctcaaagcaacttcagtgctaattgtgtacttgatcatattaccttgctagaaatgtgtgagttgtttgatagtactagagtaagtgactgggaagctgcttttgatccctagattctgttgtataaaaaatagcttcccgtggtttatgatctgttccttttccccatcgttcttaaggtatgctgagatatgctgtgtttcttatctgtatttgaaaataaaacatgtctttgtagtgtgtattcagcaagcgaaacagaaaattatgaatttctacttatgtgtgaaatatgctctgtaatgcatgtcagtgtctcaaatatgcttaaatatgatcattttatgtagtttaaaaatactccattataatattggaactttagaccataggatgcacagcttctagtcccagctctgtcactagctatgctgaaatttcttcacctgcaaaatgaggaagttggactagattttttctaaagccccttgatatttgttctagattccatgtttcactgtttgatgactttttactacaggagtccttcttcattttcaagacccagcactgcagttaagtgacttgtactttgtggaacccaagtggctttgtaaaatcatggcacaggttggtgtcttttatttttgtggcacgggggttatggtcaaagcatagaacagatggcgcccagagcattgagcattttagaatttgggtttagttaaggcagaaacttttgtgaatttggaaaactgtggaacatttcacatagaagactacttgaagagcttcatggaagaaggaaagatgtcttgagttcacttccatgacttggttttcaagccacatacagatgtttgtatcactctgccccatgctgctttactagatcctgatgatgtcattggtttggttactgaattagtcaattgaatgatggctttgtggaaatccttggggtaaacacatataagaaaattaggttgctgagcctgtgaaacctctatctagataacatggaggtgagttttgacttaagtgaaatgatctgagctttaaatgcttacgattttgaaaactttggatggccttggttatagctatttttttcttatatttcacatggaaaatgatttttttctccaaatgataatccattaccaatgagtttaattagttataataatccatctctgtagctttgacataaaagaccatttgagcaaaacatactacctcagggcttttcaaccccagcatgatgacattttgggccagataattctttgttgcacattgtaggatgttagcagcatttttggcctttatattcgagacgtaagtagtatcctctagctgtgacaagcaaaaatgtatccagacattgctaaatattgcttggagaatgtgaaaaattaccctagttgagaaacattaagctactgatttgttgatgagtaaaatttatagttttgcatgtggctgcccgagttcctaaaattattatatatttttatgttagaaatatctcttccaattaaaccataaaggtaattaaattcactcaggcagccttgaataattgttcctaaattccatctaaggaaaaaaaggaagctattgtgaagagagaactcagttgaggctaaatcctgtaccatggaactcaagagcatattgaaacattgcaatcagcaattatttgcagtgtgtcagttattactattttggtaggtatttttaaattagattttcagccttctgcacatatgtcatggataatgtgattttactcaattattaaatgataatggagacagtagtgtgacccagagcacttacttgagcatcagcttgacctacgtttcagtctctttaattacttattagctctgtgaaatttcttaatgcattaagcctttgtttacttactttttaaataaggaaaataacaattatcttctatattgcctccctggttcagtgtaagtgaggggtaaatgttagctaattttatattggatctatttggcaatttaaagaatgttaatcaggaaattttaaaaaattcagaactataaagaggtacttacgtagttttggaaagtgtgtcatgtatggggacaaataaaaaagatgtgtaggtagctgcatcctgtacagcaaaggaagttttaaatatatccagcaattttgttgtcctagctggcgcacaatagttatcaggaggtaactcaactccacatagtcaaggaaaagctaaagttgctctctaaagtggtgtgtttccatgtcactatggaacacttgaagttgcacacatgtgaacattaggatgggtatatcttatacagtagaataaggaagaggtttgcatcagaactccccttttaaaaaaatgcagattttcactatgactgcaataaaattcctgaagattctgtggagtaattaagttgaaactccatgaaagttcttctcattagcatagttataaatatgataatttaagtaaaaattaagttaatttgagccactcaaagttacttttaaagacagatttaaaatgtcaataaaatgataatttaaatttccgattaacctaaaaaagaagtgccatcatttttatttatgccaataaattgaaatataatgtcattttatcactaaggtttaaaggaaatgaaatctctaaataatcaagtgaaaccaagagcaacttgtctgacagctattagcaaaaataaataggagtattcaccttcatgaatcaaggcaagggccggaataatttcatggtgcagaagctctaatgagcccacccactctatgcgccccgagctgttaggtcactaaacttattaaaaaaaggtaccattaaggcagggagaagtttacaagactcatttaactgtatgataaaagagatatgaaagagacctattcaattaatcaggtggaacattaaaaagcttacatggcaatttaaccttgataaaaatacatgggagaaatacaaaggaatttggaaaattctctttccttgaataaggcatcagttagctattcaggttatgaggttgaaggaatgttaggagctcttttaaaggtgataaagtcaagataatgttgcagattttattcttatgtaacaaaccccctcgaaacttggaggcttaaaatgtgaacaatttatcatttctcgttcttctgtggcttgactgggctcagctgcgtggttctgctccacatggtattggcaagggttattcacttggcttcattcattaaactgagctggaaagtgcaagaaaggtacatgcatgtttttggagtattggtgcttctccatgtggcctatcatatggctaagttgggcttcctcgtggcacggtgatcacagaataattagacatctttcatggtggctggttaccaagagaaatgaagcagattttttctgtcctcttaaaggctaggccaaggactggcaaaaatattaattctgctacattctagtaaccagagcaaccacaaacctagctcagattaaaggggaaggaaaagagactctatatgaatagcacctatgtatagggatggaaatgatgtgtccatctttggaaacttccactataaatagtggtagcacgctatagatccactaggaaaatcaagcacaaactctttaaaaaataagtgtatcttagtaaaatagattagaataactagataataatggctaacatacatgaggttaatatgtgcttttcaaagattagctcatgtaattctcacagcaacctttccaaatggtactttattagcccctatgatacagatgaagaaattgattgacagagaggttgaataatttatccaacggtacacattcaggaagaggtagagttagaatttcaaaccaagtagtttgactccagggcctatgagtttatacattcatagggctgatattcaaatgagagaagagaagtaataaataaacatataatatgttgagtggtacagagtgctacaaagaaaatatgaagtgcagttggagatgaattgtcaaaaaaggtcttagcacttaaaaaacactaaaacagcaaacaattctctttaccacctaaactgtaagagcgatctggaattgctataaagtacacaacatgggagaagtcttaaacaacagtttttattatttataggcccattgcacactgtcattaaataccaatatgttcaatcaaccatgcattcattgattcaataaatactgtacatacaaaatagaaatacagaaatgggtaagacaagtccttgggcctaaggactttataacctggtatttcactcaactacatgatagcataaataatgtttgcttctgtttaagtattccttaaacattatagatctcccaaagaaaattaaatacaaacctctttttaaagtgaatttgacaaagcaaaataaattggaatatatagataaatatgctaaaatttgtcatatgtactttgcgtactttacatgtgttatttcattctcagggcaatctaagacagtcacttttattatctcattttatagagaagaaagctgtgcagtaaagaaatcaaatacctttcccaaggttacagagctagtagtagagcctggatttgaatctgggttctgactgatttttaactgccatgacaaggatcaaagctcaaagtgtgatctctgtgttagaaacatcggggttgctctttaaaaaagccgattctcaggcctcaacccagacctactgacccagacactgcaagtagaatccatcaaaatgcagtagttactttgagaatcatgaaactctgctacacagtctgtcttcctattcatggaagtcctctcctagtatataaatgtgaagtaatatttctatttcaaacctgtattgataactgtctggaagataattttcctgggaatatattattgatgagactgcaaaacagatgtgaggtattggattgatctttccattgtagctagggaaatactgatgttcattgtttcagtgaagttcaatgatttcctatccgaattaactcccttaatttaacaattttttttttttttttgagagtgaatgcccctctgggcttctaggccacatggttgctagagaaattaggtactgtgttgcacttgaaaacactaaaatctttctgactactttcactgagcaaagagacataaaatgctttaaatttgcaacatttcagaaaataaattttagtgattatttatgactcgaatctttcagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcaggtaaagaaaaccttaaaaaattaattgctacatggaaattcactatctattcttttaattgtcaaactaactgtagtctataatagatgtattaaataaataaatatattttgcttctagtgtaaacctcctactgacatgtatcatttattttggaataaaacattgcatctgacactttaacaatatagtaaatcacttactttatgtgtatagttactagttggcttatcactgttgaaattatttaagaaaggtaaatagtggagattaatgtgtgtgtgtgtctgtgtttgtgtatgtgtgtgttcttaaacaacactgagagagtttattaagcaagttctgagaagatagtgagttttcaacagaattttaaaagcatttatggcatcacaatggatgcctatgttttagcctatactatggaaatttttcctactgctctaagcaactgggaaatttataaagtaatatgatgttgaaatgtgcaaattacattgattgatggatgcagccaattttaaaaataaatatacactttttttctaggacatgtatttttcaggatttatataagattacatttgtctatgcataactaattgtaataatttatgtattagtgcacagggattaccgaaaatatttcatgcatctacatctgagcatgcatttgaattggttattgaccactgaatttttggtgtaggaaaaatatgtagtgaaacaatgttacaaaaagattacaattgtttggaatgattaccttcattgactttaagcagtaaaatcatttgctcaacaaggttgggtgttttgtgaggctgtataaccatagtgtccttttgcctttagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagaggtaagtatctaatgaagacttattagatttttagagactattaatttagacttattaatttttagagaaattagggagatggcatatgaaaagtaatatgccattttctcagagtttacttgtttggaaggcagctgaagaattagaaaataagctcataaaaccttggagtaggcaatctaaagacacacaagcacatataacctcatctaatttgtcaggaagaaaattccttaggtgctcactcagatcttgactgtgattacattgtagggactgtaattatctcttttctgttgcacagccactaagacatttacaaaaaaagagcaaatccggtgtttataatgctaactctttcttctaaaataaatagagacattttggtactccaaagggaaaatatcattttggggattaaaattagctttacacaggtgttactggtttccaaaataaaccttaccttgattggaattaatcaacatataggtagttacattgcattaaaaagttcagaaagttttgcgtttagcatgatcaaaaacttctttttaaaaattatgaggatttatttatgattttctttcttcatctgtcgagcatattaaactgcttaacagcatcaacctgaaatggatcttaatgtgcaggggatttaactctttttattgtaaagttgtggataaaatatttaatagatatggatgaggactcatatcagtaacaacccaatactttatttcaaaatgaatagatctgtattacaatcacttgtgttgtgtgcagtagattttttccctttaacttaggaagcagttaataattaatggctccattttttagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggtaaggaaatcaatttgaatgttttcaattgcaacactaaagaaatttaaacttaaaaaaaaaaaaaactttaccttaaagctttgcgacagtatgaggtttagacaaggtgttgagctctgttttgaatcatgtaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggtatgttttgatacaacttacaaatgcttttaagtgatccttcaatacttatgaagtgacttttaataaatgtaaatattcttatccataagggatgagttgaaaaatagtatattcaattatagggacagttcagaaaactgaattatatttattaccaataaaatcttgtattctagattcagaaaatgttgatttgagggtttgaatgctggcttattgagcaacataacctcatctgtgaaaccggaataccaaccacatctatctcatagaactgttataaagattcaaatagacaatacatggacctaatttaccaacatgtctgccatataataacagctgcagcttcatgaatgtggcaaaagcagagagtagataactttctagtcagatgtctggtagtctgcagcagttcagaattctacaagtgaacgtaggaataagtttttaaaattccaagtagatagatactaagtgaatctttaaaatgttctcaaatttcctagagaaatataggattggttagaaagggagggattagaaattatagaaaatattccattattttttcacatcaaaaccacaaatttatgtatctccttaaatgttgtttttatttaaaaaatgttttattacttctcaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtaattctttttgttaatttgagaataaaaattaggatgtaattttctccttataatttagaaaatagatttcataattatattgtcatagattttactgtcttcatatatttgttataatttttgtatttggaatgatatattttaaaggaatataatattacagatctggaatttgttttgcacataatcatgtagactaggatcaagatgaggatgagattatcatggaagcagaaatatttatgaaatatatctttgtatttgccttaattgccagggatatgggaggcaaataagacagttttcaggtgagttaagtgaagcagccatattttataaaatgacagaataggtaaaggaagcacacctcagtgtagccatagcaggggttttatgactcagtgtgacaatgctgaattctcatagaaatattcattaaaagccttgaaattaaagtcaaaagtgttacatggtgacatactcaaatacttttttttttttttttgatatgctgaacaatttacatttcttggttccgtgaattcaatcagtgattttcagtagagtatgatggaaatcattgaattcatgtagcatgtttaggtgctcattgagaaaaggtgaagtcatggtaaccatgtttcaatattctcatttgtatcttgacttcctgcacatggatttttgggcctaaaagatgtttttaaaacatgctcatacacttcagaagatgaaaagtgtatgcattataactactttgggaaagaaacagtcaacatatgttactgtatgtcattctgtagattacatgtgtggtttctcatgtctctcagaataaaagctaatgtctttacaagacctgcgatgctgtgatctgtctggctcctcggttatcatttttaaaaaaagatatactttgtacaaatttttttaattgacaagtaaaaattgtatatatttatggtgtacaacatgatgttttgatatatgtatatgttgtggaatggagaagtttagctatttaacatatacattatctcaaatatttatgtggtgagaactattaaaatctactctcatagcaatttacaagtatacagtatgttattattaactgtaggctgacatactcaagttttaaacattcctgagagtcattgggacaactatgaaatgcattagattgatttaatataaagcatttgaagacaattttgaccttactttgtttagtttttgttgttgttgtgtgtatacatttaattttaatcaaattaccccagaaataatgcctaagatctgtcagtcaggacataatattattagcaaaaagttgtccaaaatttgagacatgatatttaaagctaaataaactcctttatacccctcttattggcattgattgggaagtttaggttgaatttaaatgctttggaactcaggaagttaatgtattagtaatagtgggttaacataaaatgctgaattgtccttgctgaatcctacatcttaaccccagacttcaaggtatacaggaaagtaccagacatggtgcatccttcctctgaagaaatcccaaactgtcagacacagatccctaaaatatttctttttcctgcattaaaatgtgtttcagatgaatggacacgttttgagtagtgtatgtggaaacgtcatttacaaagtctgtttagttggccaggtgtagtagctcactcctgtaatcccagcactttgggaggccgaggtgggtgtatcacgaggtcaggagttgaagaccagcctgaccaagatggtgaaacctcatctctactaaaaatacaaaaaaattaactgggtgtggtggtgggcatctgtaatctcagctactcgggaggctgaggcagagaattgcttgaacctgggaggcggaggttgcagtgagccgaggttgtgccactgcactccagcctaggcgacagagcgtctcaaaacaaaacaaaacaaaaaacaaaaaagcaaagtctgtttagctacccatataggaaaatgtttgtgattactctcccttctctagacccatgtcccataaatccataaatcccatgttcatttacagaaagcagtctagataggagtttctcagtctttgagctgttgccattttggcttggataactaactctttcttatcgagggtcatcctgtgcactgcagaatgtttggcagcatctctgtctatccactagatgtcagtagtatctccccttccctcagatgtgacaatcaaaaatgtctccggatgttgccaaagataaggggtggggttgaataccagtgatttaaacaaattaggtgtatccttctaaaaacattttacaggtagcgactccagcatctttatattagagtaatctggagaaggttatgcctctctcaattttccctctttccatttttatttgtagggcagcaatgcattcaggcttttggtaactctttttcccaagatagcagtaactattatgcagtgagtaatacgacccaccttaatagatatgaatagacttgttttgtgaatatattttaaaatataaatgtatgggattctgttcatgcgtctgagaagccacagggtacatttcctctttgtggagctatttatttttctggagagccaagacaggtatttccacttcagtggtgtgatttgaggggttaggaaaatttccttgccttcaattttctttccaacctagatgtcacaaatacataatagtagtccttaactttatttttgttttcagtcacctgaaagacatgacaatccatactccatattaatgcagcggcgattctcaaatagagaagggctttaaaaaattagaaatctctgccgggcgcagtggctcatgcctgtaatctcaacactttgggaggccgagatgggcggatcatgaggtcaggagatcgagaccatcctggctaacacggtgaaaccccatctctactaaaaatacaaaaaattagccaggcgtggtggtgtgggcggctgtagtcccagctactcgggaggctgagtcaggaaaatggcatgaacctgggaggcggagcttgcagtgagccgagatcgcgccactgcactccagcccgggcgacagagcgagactctgtctcaaaaaaaaaaagaaaaaaaaaaagaaaaaaaaaacaactagaagtccctactccaacttgaaatttggatgtatctccctagagtatgtttcttctctatgctgcattgcaatttttctttgttgttgatagttgtccagattgaggggaggcagaacaagatgcatctatatgtttccatctctccgaccgattctctcccttccccctctacttgctttctttctcttttccctcttctgtttacccgattctatttctgattccagtatgtaacagttccctctgaagctctctcaataccaacaatcctaactaatggtttttaaaagtcaaatattaagtactggagggatagaatgagagaataccaagactgataagatgcaaataatacttttaacatatttacaatctaatagaaatacaagacatgctcaaataagttaattattttaatatactctctctgagcataaaatataattatatatgctcattatagacatataaaaaataaataggtagaggctttccatagatgtgtaatttcaccacttgaaaattactatatttccttatagactgttttgtgtgtattcacttatatccatcaagtgactacatttcaaggcactatatgagaaccataaatattgtacaaacaggatttgctaaatgtcggtggagagtaacagtccacggggctgatcatggtcagtttgtgaggcaggcctccaaactccttggggattgagatgatggagtagcagagctcttcaagggtatggaggcctgaaggtacaaagcatgctcaggaaattttggctattgcggtttgtctagagcacttgttctcaaccttacctgctcattactaattctactaagtacagaattaaaagaagaaaaaaatctaatgaccatttcctcctgggactaattagatcaaaatctttgaacccagacattagcgttttaaaaagctcctcagatgtactattcagccaggactggggcagggaaagctactgaactccagccttgagaatgagaagtagaacaagaggagaactttaaaaggatttaggggccactatatgactatggagctgaatttagatttgatttagtaggcaacgcggaataatttgtttctgaacaggagagtgacacaatcaaagtggaatgataggaaaattaattttgcaagagagagagaatgagttggaagtaaggaactcagaaggcctcctgggactcagcagaaagctctgaggccaccaaatgggtgtggtggtagtggaaatggagaagaagggaatgtaaatgaggctacacagtggactgccactgttagccgtggggttagaccacagcaagagttaaaataattcttcaattttaactccagaagggcctcaaaaagactttttgtcttgttatcatcagctatatggaaggtagaataaaaactagttaggagaaaaggtaataaatgtggcttttgataggctgtgattgagttggaagggcataccagtgaaatcaccaacacaaagttggaagtgtaggaaagcacttaggaggtggctataagtgaaaatgtgaaaattctctacattaaagggatagatgaagtcacagaagtggatgacataattgagcagggtatgtgtagagggaagacgggaaggttaaggacaaaatctttacatatatctttcttggagtagaaggaagaggaaatgttaaaggagatttgattcaatgaaacaagtaggtcaggtttctattcaaatttacaacagatataattacaacagatataatttatttagtttttttcgcttggacagcttaatttaagtgctttgtattttcttttcaaaaggtgatggcagttttggatcagtttaccgagcagcctatgaaggagaagaagtggctgtgaagatttttaataaacatacatcactcaggctgttaagacaagtaagaaattcaataatataattatattaaattgcacattattaatctactggaactcttattttgcatacagttgtgaaaatgcaaaataatgaccacatttctacttaagtttaattatgcaatcctagtttgtcttttcgttgtggagtagaaagttttgtgttatttctcctgttgagaaacaaaacactgtatctgagaatccttataatcgtgatacatagtgtgttgtaaaactttttgtaagactcacttacactcctctttttactttagaaccttgctgttcaaaatgtgctccatggacaagcagccaggcattacctaggagattgttagaaatgtagaaacttgggacttttcagtgccatattattgttcctgatactccacagtagtcagactcctagctgcctccacctgcttccagaccttgaagcctagcaagctcctgacttcgccttctgttttcttcagagtatttatcttttacttttctggtctagggagagaatgatttttatttttattgaacatgacttctgtgtgttcagggtgaaagaagaagtttaatgcatgatctcacattgctaatttgattgaaggttagaaatcttaaactaaaactctcactgataagcttgcacctctcttttctggatttatccactttaataagaactgctattgattacttgctacaaagatggagaaagttagcatgcttatcctatttcctactccctgtccctgtccacttcctaaaacttaaaattggttgcattaattttcctgatatagtaacaattataacttggaatgattttcaaaacttttgtttttttagtataccaactctagacagcatggactgactccttgctatgtgagatgaggaaaattaacgctattctttctccttttcccatcaccttctcaagttctttaatttattctattatttttatgtagtgaaagtttataacatttatattctggtctgtactcataattaaattgttcacattttgtctatagtttggttctgagaacaaaaccaataaatgccatttatatatttttttatttgtacagaaccaaaatatttctacttctagataaagaaatgcaaccttctgtcactaacttcttttactaatagaatagtaacattccaaatatcaaagtcaaatggattctctattgttatgtatttatcatcaatttataaaaataaaggcatattttaatttggtcacatttttaccctgatttaaaaaaaaatttgtttttagagatggagtctcattaggttgaccaggctggtctggaactcctggcctcaagtgatcctctcaccttaaccttctgagtaccagtggtgatttattttatgtagctttttgaggttttctgattatatacatatatttttaaaaaacgtacttcaggaaaagatatatattttcatcatgacttcaagtgtttctaagttcttaatcatacagtttgtataacagaatctactttcttcttgaagacattcctcattcagcacatgacttactgctctaaacaggagagatggatttctaggctgcttgtgcagtgattaatctatgagttagtttcctcgccctctttgattactctcaatatttcttggattccatccattctcttggttggattgtccttagtttttgttgaagaatatcttcgagtaatttttttaagaaaaggtgtttgtgaggtaaatgttttcagtccttacatgttaaaaatatcttagttttgccctcccatgtggtggatatgtcatcacactttattttttaggaatctaggcttgaaacaattttcttcaaaatttgaagaaaattccattgatttttagtgcccactgttgctaatgaaaagtctgcagtcagtcagatgtttgctcctatctaggatacctttaatttcattttgaaaactgaaaatttgaccttttgaatttcatttgttttcagtgttctgaacctttacaagtatgtgtttgtgtgtaggttgtttttcattccatctaattcattattttgtgaaaaattgtcttctgtgtattctcttctattatttattatttcctccctaacatttattaatcatttttattgacaactactatgtaccaggttaggtgatgggacatatgatatatatatagtagtaagctaaacccagtcaaggctctgcttctctggagcctatatctagttacttatgattcattattgcttatcattgctccaagagtatatgttagatgacaagccttttgggtctatcatccatgtttgagttccctcttcaagttttatctataatttgtgttacttacttgactgtctcttacaggtttctaatattttttagaattgcatcatctattatttagctttctggtgaattttgttttgataatcatattttccatttccagcaattctttccatcccctctggttgttcctttgtagccatgtttttggataaaatgtccataggtgtttctgttcatgtcaattagaatttttttttgtattacttgcattattgcttttttctctgaggttatttgctctgtgggttcatcttgatctttctcttttatcttgtcagttttccaaattgagtagttttgggtgacttcgtatgaagtaagtactctattgattgttaaagaaggactgtattgattattaaaggtaactagaatgggcattcttcacattcatgtaggtttgcttgttcaagttaccactttctgaacaagaaggttagaccatagacttttaagggctgcatactgcaaagggatactctgttctttaggttacatgggcagggatcactgctgagaccatacctgccaaaggaaggcaggctttgctctctagatgctggacttgaaattgtttcccctctgcttagtgctgcattattttttttgcttcttaatctgctgcagagtatctagatcagggtgtccaatcttttggcttccctgggccgtattggaagaagaattgccttgggccatatataaaatacactaacactaatgatagctgatgagcttaaaaaaattacaaaaaaaaaatctcataatgttttaagaaagtttatgaatttgggttgggccacattcaaagccatcctgggccacatgcgacctgtgggccacaagttggacaagcttgttctagatacttcagactctgttctacatctcttcatagatcaataacttgcagcaatgagtttatcagataaattatgttcacttttcatccataaaaaaagtcatgggaggtactcaccataggattggtttaatccagtcactctggccaattttctttaaaattcctttaaccttggtatattggtttaattccttcagaatggcttttcccattgtgataaactggttccaggcttcacgagtacttattccaagtacagaaggaaagagggtacctcttttgagtacttgtatttcaaaggaatcaaatggcctacataataacccattaaataaatagatgtctctcagccccagtgagtcatctgtgcttttctcaacaagcactatgttcagggcaatgctttgtgctaattggctttaggcctttgttaccaaactgatcactgtggccctgagggtgctgttacttagaatattcccaccttttctgagaggctgatgttggggtcacttccccctgaactaaagtccaggggctgcatgggtgagggttgagtaactcagtactctaaggaggaaaggaaggggaatatacactgttagttaacagtggttattcctgtattctctcttgtttggattctactggggatttctttctttttttgagtctttattgacattaggaatgagagatagaaacagggtgagagaggaagtaaaattaaatgtgaattcttccatcttataccagaactcaactgtatttttggaatctatatatccttacttttcccttgatttattacaaaaaattcttagtggctacactaagtaaattttgtaacctttaaaaaatacatagttataatattttaagtactctgagtaatagaagatttcatgtgagtacaaaatatcctgggggcattttaattattagtaacaacagtcacactgtagttctagaaccaaattgaacattttatatatagaagcttatctgtgaatcaaatctgacataatctcttttaatgtgtaggtaatttcttatataaattgattttttggccttgctgtcagcatgcatttcaaattttacaccatgtgtttggggagctatggtggaaattagtacattaaaaatgtctacagagccaattagtgtataagcagggaggcaaactaagggaatggtggaagaaattaaaaaaaaaggggtgtgcataatgtgcttcttctcttaaaaaaaaaaaaagaaaaagacaacaacaaaaagaaagaaaaatgacatttgacggtcattctaccagtagtcatggggcagatctatattatactgtactattacgctgttttttctttgcaattagtgagttgcttttccaggatagaaaatttggattagacctctgtctgtgcctatgaaaacaagcagagctaacttaactccttctcatcagttctaaccaactgacatgggcattaaaaaaaagattttatctactaagcaaatatgatcacagtctgaagctttgttcttggaaaatcccctctcagggtgttcagcctttcttcttcagcttgcagaattctccatgtttcagtttcctgataaatcagtgggcgccgctactccacatctttgaagctggttgttaagaagcagtgcttctgcagcaatcacagtttaaagcatgaatcaatttaacatcacacaagctatacatttcaacagagttacagtttcagagtaaagtgcaatatacagtataaagcgaatctggaattcaagcccaacaatgtcataaaagaggctgtgaagtctcacatgatgtgggccacagagagggttgttgccattggatcttagctcaaatactaccacatcttcggagtggcctgccatgggccacccttactaaggcaatccctctgtccaagccaaaatgatatctcggactttttttgaattgcagagagattgttgcagccagggattgccttagtaagggtggcccatggcgggcctctctgaggatgtggtaatatttgagataagatctgaatggcaagacttcagccatgtgaagggtggagggatttctagggaaaggggtcagcacaggcaaagaccctatgatgggaagaagctgggcacagcttgggattgaatgaatgccaatgtggctgaagggtggtgattgaagaggagggggagacgagaaggtctggaaggcctggggcatgatcagatcaggtgctgaggccgtggaagtagatgggattttcatctaagggaaatgggaagtcattagagagttttcaggaggggatgatatgtatttttttaaaattgagcattatcctcggtaaacttttgtagtcgttaaaccagagattataagcaggttttacctcatatgccagttgcagctgattagtagtggctatagagaatcctgggctgagaaggatactgtggctaaccagaattcagtagatgagtttgacgtggcctgttagtatgactacactgtgtgcactgtttctgcattaaatgtctgataaaaacagagccaaaggaaaaatagaacttaaaaatttaattctgacagtacagttgacccttgaaaaacataaaggttggggtgctgaccccttgtgcagtcacaaatttgcatataacttttgacctccccaaaaaactgaaccactgatagcccactgttgactggaagctttactgataacataaacacttgattaacacatgttttatatgttatctgtattatatactccattcttaccataaagcaagctagagaaaagagtattttatttaaaaaatcataatgaagagaaatatatttaatcttcgttaagtagaagtggatcattataaaggtcttcaccctcatcatcttcacattgagtgggctgaggagggggaggtagaggaaaggttggtcttgctgtctcaagagtggcagaggtggaagaaaatttatgtatatgtggactcatgcacttcaatcccatgttgtccataggtcaactgtagtttcaaaaccagctttttattactgaaaatacgggaaaaaaaactcagagaagaaatggaaagtttgctatgatccagtcatacagagaaatccatgttcagcctgttgatgcactttaaagaaggagatacgtgggtaaaacctgatgttgaattactcttacatgattttggacttttgcaggagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgaggtaagtaggtcatgttgttttctattcagtgcatgacaagtgtgatccagacttgctctcaggttctgagaacacttcccagtaacactgtgccccagtaacaatttataaacaatttggatgaaaactaccatttccctgatcaaattttgtaatttcagaaaataagagtatggaaaccatgcagaacctcatagcaagtagtaatagactttgaacccacaagttctgctctagaacccatcatcttaaccctgtactgatctgccttctataaaaatgtataagttaggcttcacagtatcaaagtaagtgtcaattacatgattccaatgaggaaagatgagtccatacttctcaaggggactagagtgattcatgttggattcttcggcatgaccatctcacatgtctcagaggcacacctaaccctgcatccagagcaagctttggagagggagcacactggagtggaaaggctgtggtctttgaagacaaaaggcctgggattcatcactattccacacatttagtaactgtgattttatatctctgattcccattttttaaatagtctgtgaaccatgactaatatttaatgcataaaattatgatgacttctgtaataattggagacattccagatgaaactcttgatgtcccctctgccattgctccccaaccccagtcaccctgttacacctgagagtcaccttacattcctttcttcctctctcatttcacagctaatccttcagcaaatcttttcagctctgccaccaaaatatatcttaatgcttctaacaatttctctcactaacgtctaaatctgagccagtatcatctctcattgcctactggtcccctgcttctacctctgtctcatgatagtcccattcctcacccagcctctggagtgatttttctaacatgaaagttggatcaggacttgttcctgttattacccctcccctgccttatttcttgggtacagtgctcagccactcccatccctgaggttccttgcagataccagaggctttatatctgctgttgatttcactcaggaatgtctgactcccagatgtgctctctacttattataaaggattatctgaatctttctgaatcctttcatttaggactctcagcagagaggatgtccgcaacgaccctttgtctctccagcccctataggactattgctgcctaggattctttatgttttcattttttaaaaacttatttattgtctgtcttgccatcagaatctaagtaccatgaaagaagggacttttcgtcttgtttgccattgtatctctagctcctaaaatagtaagccttcagaattactgtgttgacagtaggggaagggggagaaaggaggaaagaaggaaaacagtgcctggggcatagaagccaagcagtgtatgcaactttccttctcttctttctcttctgaaatgctatgaatatgccttttaggtagtatccagaaatgttccttcctgaaagggtccagaaactactgaaaactgtacagattatgaaatgaaacagggtgcagggatttggatttgagttgatgtttctgcttttgaacaccagggggaatcttgggttacattaatctaggtaaagtgcagaatagtctcctgtatttcagtgccctctttccttcatttaactaactctaggttctagtttttccctaattcttccacaaatccccaaagtgtttatttataaagtgaagaattgctattttttaacactgttcgaaacaccttatctctaaaatgacttattctagttctctgaaaccttactttaaataacaaatccagcagtttctgatgaagtaaatgaaatgtcagcatattttaaaataatttgcctaatttgttcttagcataatgccagaaaagctttctggattttgtatcacaaaaggctagtagatttcagtagctatcaatcttctaccagcactaagtatattttaaaaactcagcattaaggtttatttttccaagtatgtttcagcacaggaaataaaatcatgctcctttggagtcccttaaatgctggagctgtttagagtgacatacaagaactttcttcacgttacatgctctctcttcctccatcttgcttttaactgttagcttacttctccaattcaatccacttcgtttgaactctttatcataattctataaaacttatgaaaatacagtcaactgcattttctgtatgtttctgtgtttcaatatcttcaaaatggaatgtactgccttggtacatcacccactatgaatctgttatttctgttatatcccacagttgccaggccaggatacttgtcccatccaggccaaacaccttcccccgaaagcaagtatgcatttgtccaccaggtccttgactctattttacattatctttttagtcaattcatttatttttatgccactcctgctgtcttggttcagtatgtccagggaattatcagaatttcttttctaaaataaaaatctgtttatgcttgcaattccttgacagttctcaattatctgcaaagtgcatccaaacttcttggcatagcatcaaagatctttctgtatgcctcttgcttccctttgcggcccctgccaccccactgcccacactgcattctagccgtgatgacaggcttgaattttcagttatgctcatgtctgtccatcattgtatttgttattcctctctttccaccaagttgtctgcctagagagctcattttccttaagaatttcttcacaaaccatctctactatgaagctcaagtgtgtcatgaagtgttagcttctccaacttgtgtttcttgcagacactctgtgcaagacattgacttaggtgctaaagagggaaagctagatattatattgttcttgaggttgaaagcttacagtctagtaggagagtcaactttgctgtctttacctcagtgtttttctccctctgtgcttccctagcacgtggtacttacatatttctggaatcttgattaaacacctgtttgaggactgtctgagcacaatccttctggattgtgacaccctcaagggagcagagatacaaagatggctttgtatactaaatgactggccctcatagatacctagtacatatttgtcaaataaatgaatgcattctatttttggaataattctattcagaatcagataaagtttactttaagctatgaagaaagaagtctcttagcaactcttacaataatcacaatcaaagaatgactgtttaacttaatataaaccagtttgttttaataaaatatttgacaatagtcatggttacacaatgcataaattatggctaaattattatcaggaaggaaaaatctttacttattatttcaaaagctattttgctagtctattaaaagctattagaactgcacttcttaagattaaattctataattgaacattttaactaaccaagatattatctctttgccactgacattatttcaaattaagcttaactatttctttttagcctttggaaagtattctgaaagagtctgtgttctataaatatacttaaagaggcatgtcttataaaggatttggatactattcaatgatgtatgacttggctttagcttttttattcttaatctctcagcttttctcttcagcaggggaagagtacctaatggcctttcagtaatcccttggtaaatttttctttcaagcccattacttactgtgaaggtcaacttcattagtgtatttatcttatttttttcagcccaaaataggtatattgaaatgaatgggcctaatgtcaaatgtcccgactacatcctggaagagagagaatcttcagctgtattagttgatgcagttaaataatatgtactctccaggccctcatacaattgaaagttcagggtatcgttgctgctctgcttctaatccttccagaagtgattggtgctaggtgatggagtaactattaattgatataatgtgagccaaaaccaacagtcacgaataagcaaaggatttaaatttaactccattaagtcttgtgagaaattattttcaacataggttataacatacctgtgacatcacatgaaatgctgtagtcaatttgacatcatggggcagagaagacagagttggaaatcagaattttatagacatctaatgtgataataacattagtagctgagatgcggtaagctctttgaccatgtttccagaatggataagacctggttgagatgaaaactttacactgtttttttatattaactatcttttactctttgcctgaaatgtccaactctagttgctcgtgattgcgtgggtcagtctccagaaggttggactttaatattacccgtcatcttttccaagacaaaattgtattcattctaactcttagccccaaattttcttttttaaccttaatatctaacatgattaggtttatggtaaattatatactcaaacagaagaagagactaatagcaagcaaaagtcttatattttcatttgttttcatccaaaaagtagaaaatattttccaaacattgggaaacattttagtcagaaaaataaatatcaatgataaatagaatagagaaaaattttaaagctgagctaaacctctatgtggttttaggaaaatcaaaactattaaataaatggcaagtacaacaaaatcccatcaattcttatttaacatacttacattttgaaatagttaaaatattcatatgatcattgagagaattcagaattgcctttaagtaattgttcacatatacaaaagaaaagtctccaaaaattgggtctttgcctgagatagatttgtcttaaaattgaaatcattcacttatcagatttgacccttttttaaagcataactttgctgtgtaatattagacttatatgttttgatttccttctacaatatctcttaactttaagggacaaagtgagcacagaatttttgatgcttgacatagtggacatttatatttaaggaaattaggacaaaaattattataatgtaatcacatttgaataagatttcctgtgcattttctggcagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccaggtaggtgatcaggtctgtctcataattctatcttcaggatggataaccactgacctcagatgtgagttcagaagagtcaaaaggaaaacagagtctatcacattgtgaacagaggtttattttgtgaaaaaatgcaagcatcacattgtgatttttatcattgtattttgtaggaaaaaaacaattgatgtaatttttcagggcaaaaactgaataaaaagaagagaatgtttgatatcaagttatatgttttaaagttagatttgtagattctttagatactctagaggtcataaaaagtaacagcaaaaactttagtctaggtattgttggcacttgtgaggcaaatcaaattcaggtccacaaattctttttcataattctgaaacccaaagaactctgaaaatcccaagattttttaaaaaatgactaatttggtgtcaaaacctaagcaagctgacttgttgcttattacaatctttatttctcatgctcagtgtgaatatgcatacattttgctgcagaaatatatacatgtttgagtacagggggctggccgtgaccctactgagggtttctgtacacatcactgtctaccctgtggaatcttacctccctttcttagttcccaatcctgaaaagcagttatggggccagtgctctgtacagacatgttgtctcagacatcagtttgagcaggaagtaaatcatttaggggttggcatttgtttggagtgtggggaacactctatctttagggaaactttatatagttagttatttgtaagtaaaattacaggtggctatacatcatcttgctgattgcaactcaattaaatcaccgtgcctggcacagaagaaaatatgctacaggatatctcactagggaaaaggttctagttcgtttcctgcgcactcaacttttgtacttagataagcaaatggccccagattccaatgcctggttttatttttgctccaaatacatatatactcttttgttttggatagttacattttagaagtagactgtgtattctcataaacacttcaaagtgtatgttctggctgagagtgtctctgtgttgttcaataataataagactaattatcattttttgagtacctgctgtgcgtcaggcccagtgccacgtatattagagacaagatctcttatcctcatgccagggctggaagttagctattagtttctcatttgccaaatgagaaaactgaggctcagggagattatgtaacttgcagaatatcactcagtaattggccaagataagaattcagtctaaatgagaaccagatccagagatatttggctttaaattctatagtctctcctaaaccatatgcaactctaacatgaagaagcttatttaatcttcactattaaaaaagtcaaaacaaaacaacagagccatgaatagcaaatattgtcaatgagaggtttggaaaaacagtcttaaaggatgaaattccatagacctgatatatttccacctggaaaaagtgggcatgggacagtgattttctcttgaaagatctgctcatttttgtcatgggacatgaaggtggactggaccactcagtttcttctttctgcatctcccaacccagtctttctgttcatggggtgaaaatctgttgttgaagccttgtctgcttaattggacagtggatctctcgggtccctgtgggctgtgcgcttgtacttgagctctgcttcttcactctgtggtctaggccagctagcagccagctgagttcaccttggttcagactcatggcctttcattttcagtatctgacttcctggttttgctgaaaacctgtctaaaatgtaatatccatctgattcttcataccaagccacacaattcttcctgatcccttttaatctccaatattgaatggtggtaacataaatatggagacagatcatgtcagaaacccagggcctaatcttttcttttctgcctactcttctcacaggctgcttagtactttgtaagctttttttttttttctggctgtaacctagattttctctttatcattactctatttattattgttagagcacttctgattatctcagccctaaactctgcctccaattttaaataacaataactcccactcctgctaatactgctactactactaccatcaccaaactttttcttccccaaagcagttctgtttgggaaggaaacagttccctctcatacaatttcagttatcttcttgtcttttccgtttaatgaatcttcctgttaatgttacatcttttaacatggaaacttctagagaaacaaaagacgatggatttgttaaaccttttgggtgtatttttatactaactcttactgcagcgtgtgcattatgagtgtaggtccattacggctgtattaggagcagaaccttccagagcatgagcgatgtgctgggcttgtgcttagctctatccatgagttaagtatctcaatccttaggaccctctgacatatgtgctattattatttctagtctatagatacagagactaaagtttagagaatataaaaaaacatttacaaggtcctatgggacaaaaactgtaggacaaaatgcaaacccaagcagcctgagagcagagctcctggtccagcactgtgatagctggggacgcagagacagaaacaatgcaattattgacagggaccatggtgctgtgtctgtccacattttgaagataattatggtttggatattttcacctttaaataacttggagagtttcaacattaactcagtcagatggatacatttatatcatatcctgctgggagtgacagttaattctgggtcctatggcaattgcacttttgactgagatgaatgctgactgatggctttaacatttaactaatgcgatagtatttaacacacccatataaatactatagtcttcgggtaaataaaatgttaccggctggacatacatgaatatctgatggagattatggaacatactctactcatacttctctgaaagtaaaaaataaaagatatgtttcagtacacaatgtgatatgtactcagacttaattcataaatttctcttatccttcatccgtggatcttttctttatttacttattgcgtttgttaaaatgcaggcttctctgaaaaattatttttaaaaatagtttttagacaatgaatcatattttctcaagtattttaacattgtaatcattatgataattatccaaggggaaattatacttattttttattcatttattcattcatttggcaacaatacattgaacatttactaagcatcaaactggctctaccacttaatagtggcatgatgttcatcaagaaattgttagtgcaatcaagaacactagaaattcattggatgaatttaaagaagcttttagaagggtattatattataattgaggcactttatgaatatataaataatattatgttttcatgctagagatcatgccaatgaagatatttactttgaaaaggagaagattagaagtttaaaagcatttccatattgaagtaaatattcatttccatatcttcacagttatctttctctgagttctctgactcattgtgaaaaaaaatcccaaccttcttcacagctctaccatcttcggattgttgcctagaggggtaaaaactattgtaaaaggatgtgtgcactggatgagaatttagaattagacgaaatgacccctagagtcttttcctgctttaagagcctgtgattccaaattctaacagtacatttatcaagaaaaaatatgctgaacatttaaatagtttttgaatagtacctagatataatagatacctaataaatgtgctcaatgaataataaataactggttaagatttaaataagcctccaaaatctcttccacattctaagaagggaagcataaaggttgttaatgaactagtgactgtgtgggtagctcattatttttaagtactcttgactttgctgttcattatctgtgtggccttaggaaaatacacacatttctgaaaggattatgtcgtttgtaaaatagaaagtccttatctgtctaccacagatgattcttatgcaaatcaaatgaaatgttcaataaggtgtctgtaaaatagtagagagagatgaattaggagctattgtgatttgtttacattatgtcacaggtgcactttattagggatatgttttatcttaattacacaattctttaacttagattttgagaattatattatggttatataggaaaatgcccttattctaaggaaatgtataatatatttaggtctgaaacattgtatctgtaacaatatagtatgtaaattatgctaattcacatgataattatatgtaattatattaatatattactatgtatacaatatatttacatgcatatatgtggggaaatgttatcagttagtgtagtaggggttatcatactcaaattcgatgtctccatccttccaactcttcatgcttttccagcatggtgaggactgctgagctccatcttttgctggtagtctctctgtcaaatagaactgtttccaaattcagtcatttgctccttgaaggctatgaattcatacttcgttatatttttctggctgcatatttaaattactttaacaatcatataagttcattgtaaaaattttggaaataaaaaggaagataaaatgcacagataattttagcaaatgaaataataattatattgggatgtatttcttcctagattttaattatgtacattcccatcaactttttattttgaaaatgtttaagcctaaagaacagttgaaagagtagtacaggctgggtgcagtggctcctgcctgtaatcccaacactttgggaggccgaggtgggtggatcacttgaggtcaggagttcaagaccagcctgaccaacatggtgaaaccctgtcactactaaaaatacaaaaatcagctgggcacggtggtgggcacctgtaatcccagctactcgggaggctgaggcaggagaatcgcttgaacccaggaggcagaggttgcagtaagccaagatcacacccctgcactccagcctgggcaagagagtgagactccatctcaaaaaaaaaaaaaaaaaaaaaaagaaagaaagagtagtacaatatacattcatactcatatacccgacgcataaattcattgattatttactttttgccctacttgttctttcttgctctctttgcgtatgaatgaatcattgaaattaagttgtagacatcatgccatatcacctctgaacagtgtgtatatttctttagaataaggatgtttacttacataatcataataccattatcacagctaagaaaattaattcagttgattttttccacatatttgataactttctgtctatccacgattatgtcttacatattcttttaatttatgtcatagcatatcatcttagaaagtgatccctaagttactgcatggtatacattgtttaaccatttccctttgtgattggatgtctttaggttgattatatttttattattatcacaaatgttgaaatcactctttttttctgaagaatttaaaagtaatttatctgtcttatggaataaaatatttatttccccttaaaagaatttcaggcatgaacccaagagagaaggcttttttttttgttttagttgttgtttttatttttattttttattttttgggtagaaggagcagagagacaagttcaggaaataatgagagtgttagaattttgttcaggttaaagtgagttggagtgaagtttagaaatctcctttctactcatctctcctgtttttaaaacactgtcctggaaatagttaatattaggaacgagaaaaatggtataggttttcctagtacactttatttcttaattatgaaattctacttaataacttaccattgaatgtttatccttattatcattcaaggtaattttattgaagattgaagatatttataataaagattgaaggattttattgtcctgtgtggtcaaccttggggggtgagatgttatgagacaggacaattaattgacttgatcaaggtaccttgttataaaaataacacagcctggtttagaacatctcttcctgactctcttatttggcatatagcctaagtgtatgcctccttggatgtatgagccctgatgttggtcatatttattattttatctgcttactttcagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctggtaagttctgttttctctacaatgaagattttttttcttaatatcagcagcttcatttttatttaattgtagttgtatgcttaattccttaaacagatgatcattttttttgtttagtgcataaatattcttaaatcttgtgatatattaataaaaatcacctgaaaaaggtagcagttttaggctttttaaaaaatccgcaattaatattggtgtagttaatattatatttagaaacatagagaaggaaattgctgttagaactccacatttggtgatttttaattttcataaagaattactgtgtactcattatcctggaatgttttcgttttcttggagtgaaataatttacatgcaggaatggaagactgaatgatctataataataatttttcataagaatcggtaaatgtgtatttaatgttatcaaagctcatttggaatggttgtctcatgctttcaagaaattagaggactttgtaattcattccttaaccattactttagttctcaccacaaaataacattttaagtttatttagctctttctcatattttctgctttccctttcatttaaaaaatacttttgagtgtacacaatgtgccatgtacaggaaatagagctttatcttttttgggtataacttcaagatcatggcaaaagaaaacttattattaattggataaaccttagatataatctaggttatttcccttattttactagttttctagtgaaaatattcaggtctctgctgggtacagtggcttacgcctgtaatcccagcactttgggaggcccaggcaggcagatcacttgaggccaggagctggagaccagcctggccaacatggtgaaaccctgtctctactaaaaatacaaaaagtagctgggcatggtggcatgtgcgtgtagtcccagctaccaaggaggctgaggcacgagaatagcttgaacctgggaggttgcagtgagccgagattgcgccactgcactccagcctaagcaacaaagtgagactccatcttaaaaaaaaaaattcagttctgtgttctgcatcaaccagaataagctacgcctcttataaaaaacaaatgtgcacaaaccatctgtgaggacataaggattaaatgcttgcttactttgagtattaaaataaaaagtagaagctttattatatgagtaaaagtgtttccaaagtctatttgaaatgcaggtacagaatgaaaatctgttattttattaaatcgttatttgggtctctttttattccataaaaaaaaaatcttttccacatctcttagtggagatcaagttaacaaaattagctttaattttgtgacaagtaaatttacataaatataggattatggagataatatttttctttgcaatgtctggaccttttataaacattgagaggaaatataaccattcttacttatttagtatgctagcatgatgttttttaatgttttagatccagttaaagaatatggttgtgccccatggcctatggttgagaaattaattaaacagtgtttgaaagaaaatcctcaagaaaggcctacttctgcccaggtattcttaaagttttgttaatattttgtacagaacatcatttgcatatatgcatatatatataatcttcaaatatatatacttaaacacataaacacacagagacagaattaaaaatagttataaggcaaacctcctataattttcaccatcccaggcacaaaaaaaggacattgccaaaacctcacatgctcccatatgcctgtctcctcttctcttctttgaaatgcctgcccattattttgcccatttttctgttgactcttttgcctacaaatcaaatcagaaaaaaatttttatatataacatactaatcctttcttggttttatatgttgcaatttctttttcgagctggtggcttgctttttaaatttcttgtagggtgcccgttaatgaatggaatttcttaattttaatatatataaatttaacaattcttctttttccttcttttcctggttattcctatttggtcctgttgtagagcccatctttcttttagagctacaaaaatatttacctgcaatttcttcaaacattttaaaagtttgcttttgacaagattttaatccattggaattgacatttttatctgtatcccattcctttttttaatgtggaagactaattttttcaggttgatttactaaatggcttctccccttttgtcccatagatctgatgtgtccattttgtaatttattaaagataatgtgcatatccacgtgtacactgtcttccactgatcaactcatttatttttcctccagtattaccctgtcttaattcctgtagctttataatgatctcctctccctatttatttttctcatccaggaatattttaaccagtcttaggcttagcttttctatataaaatttagaatcatgctgtcaaatcttatgaaaaaccacattgtcgtttggattggtcttggattgaatatgttgacaatctggagatgatatccttatgatattaagtctttgtattctttttcttatttatttatttatttagaggcagggtctcactctgtcacccaggctggagtgctggagtgcagtggcaggatcacagctcaatgcagctttgacctcctgggctcaagtgatcctgtcgcctcagtctccatcagccaattgtgtgccaccagacctggttaacttttcctttaatttttttgtagagaaagggtctcactctgttgcccaggctggtcttgaactcctggcctcaagcaatcctcccgcctaggcctcccaaagtgcatgagcaactgcacctggccaagtcttcctattctggaatggcatgaattctctctgtttacttaggtcttctcaagcgtctttcaataaagttttgtaatgctacatacaggtcttgcatatcttttgctggattttcttgctgcaaattgctttaaatgcagttcatggcttgagatttgttttttaactgcccagttaacgtaaatctggtctatgaattgtattgacaacaagcttgtgagtagcaatttttcagcaaccttttgctccctctccccgctccctgcacagtcccagaacaactttccttatataccaatgaaggtggaaatgtggacaggttgatttctccttcttgtttatgctgaatatgcagtcctttggggtcccagctttataggtacagtccctttactaagactgtctatcttgggaaggccctagactccaacttctctcccatgggccccacaaagcatccaagagtatacatttatattatctcactttgtcttggcagacaaatgtcttcagggcaagtctggctttaggggtccactgacctctctggtttctgtctctcactgtgatttcggcctgataattccttatggtgtcagatcttcaatgtttttaatacattgtttttaaaaaaatcatttagcattttaaattgtttttagttggaagatttgcccaagtaaccttgtccaccatattatctgaaagagaactcttgtcatgttttacactgatacacattttaataaatgtgggttatctttatgttgtgagctcttgatttggtattataattaattggaaaagttttaactttaagtattctgatcaaaatagtcaagtacaactataatgactttatcaaatattacataatttttcttctacttggtttacttgttttttaatttaggttaccatcaatgttagtcacatgaacttttatatttatgtccacagtaaaaatttttcatagcttgttgtttttctttcttgttttttcattttcaattatacttcacctatacttaacagaatacttaacaaatatgtatatatatgacaatattaaaaagcttagacatacttattttatgtttaaaatataacatatactaggcaagacaggaaaactcatcacttttatgaaatgaggcacagacagagtaatgggctttcttggtgtctcctgagtggcgggcaggtggccatgtcacagctctaatcccagtttcctgacttctggttctgttttcttacggtgccttcacactgtctctccagatcaaaaacagaatctagagatgacttctaaattttgttaccaaagactgaaattcctgttcctttcaactactagaagctcaactaaattgttggcccaagggtttttctctcactggcggtggctctgcaatatagaattgcatgcagagtacctcctgactccgctaaaatcctgtttaattgacccttgagattttcttttcaagttaaaaaaaatactacacataccaaagagtatcaagcacagtttaaaaatacatatttgtcttttcatgtaattttatttgtagtttagattactaatcttggtgatctagttgggttccagtttaacagttttaggttttgcttgacagagctataacacttcagtctatatttgatttttcaagggaaatgagttaactcgataagtactgttttgttatctttaaactttctcaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggtaaatccaaatgctctttaaatctttcataatttaaagcatataccatttggaaagttacttaggaataaattaaataagagccaatgtaggattattattcaattagccttctgttagaacaagagtattcaagagcaaatgtgttttgctttagaatcacagcatatgtcttagctcagggtccctagaaacagagcctgagatgggttatcttgcacaagtgatttaaggaaagagaatcttagagagaagtagaggaagccagaaagggcagaggaaaaagctcagcagaaatgtggtttctgaagaggtccagcctcagtctctgcccacaaggagctctggaatatgaataggagcacagaattttcccactgccaggcaagggagccagtctttcattctcacatattgttcagtcattggctgcaatctgctgggaggtgggggtagtgtaactttcaaggcatttctgggcaagctgcctcctgtcatctgagggtattctgtgataaatagcacatctctgaactatagtagccaacactcagggtagctggggatggcgtacctgatggataaaggagatctggacatggctcctaaaagtggatcaatacattgtgttggcaaatataagataagtttctagacttcaaagacaacctagtattttgactgctgcctgaagataaatattgtgcctcaacattagttctgaggttaaacaatcttttttttttaattgatcattcttgggtgtttctcgcagagggggatttggcagggtcataggacaataatggagggaaggtcagcagataaacaagtgaacaaaggtctctggttttcctaggcagaggaccctgcggccttccgtagtgtttgtgtccctgggtacttgagattagggagtagtgatgactcttaacgagcatgctgccttcaagcatctgtttaacaaagcacatcttgcaccgcccttaatccatttaaccctgagtggacacagcacatgtttcagagagcaccgggttgggggcaaggtcatagatcaacagcatcccaaggcagaagaatttttcttagtacagaacaaaatggagtctcctatgtctacttctttctacacagacacagcaacaatctgatttctgtatcttttccccacatttcccccttttctactcgacaaaaccgccaacgtcatcatggcctgttctcaatgagctgctgggtacacctcccagacggggtggcagccgggcagaggggctcctcacttcccagaaggggcggccgggcagaggcgccccccacctcccagacggggcggcggccgggcgggggctgccccccacctcccggatggggtggctgcccagcggagacgctcctcacttcccagacggggcggctgctgggcggaggggctcctcacttctccgacggggcggctgctgggcggaggggctcctcacttctcagacggggcagctgccaggcaaaggggctcctcacttctcagacggggcggctgccgggcagagggactcctcacttctcagacagggcggccaggcagagatgctcctcacctcccagacagggttgcggccgggcataggctctcctcacatcccagacggggcggcagggcagaggcgctccccacatctcagacaatgggcggccgggcagagccgctcatcacttcctagacgggatggcggccgggaagaggcgctcctcatttcccagactgggcagccgggcagagggggctcctcacatcccagacgatgggcggccaggcagagacgctcctcacttcccagacggggtggcggccgggcagaggctgcaatctcggcactttgggaggccaaggcaggcggctgggaggtggaggttgtaggtagccaagatcacgccactgcactccagcctgggcaactttgagcactgagtgaacgagactccgtctgcaatcccggcacctcgggaggccgaggctggcagatcactcgcggttaggagctggagaccagcccggccaacacagcgaaaccccgtctccaccaaaaaaatatgaaaaccagtcaggcgtggcggcgcacgcctgcaatggcaggcactctgcaggctgaggcaggagaatcaggcagggaggttgcagtgagccgagatggcagcagtacagcccagcttcggctcggcatcagagggagacggtggaaagagagggagagggagaccatggggagagggagacggagagggagagggagaggaacaatcttcttatatggtttgaaggaatgagaattcacactgaaaaataatttttaattttagtttcagatgtcatcttgataggcaaaacttgtctgccaattaactcatttattgctgaaaattaaataaaattggcattgtttttaaaagtaatgcaagaaagcaaaaagagttatgttgataacagaatcctttattctgtacaagttctagttgcttaagcttaaatcaaatcctgctaagtatattttcttttcttaacaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaaggtatggtagtgaatttgatcaatggggaaattacagatcttttaaacgactgaattgtgtgcataattgttattgcatcagcaaagattgttcatttttagcctattttcattggtttgcatatattaaagggaattgtggaaggtcacagagatatttgttgtttttctgaatacagatctagctgagacatttataaaataagtcaaccatttattcaggcctaccagccctgctcctggtattacctcaactgtggctctatctctttacttctcctcagatcaatgaatctttgtagggcctcttcaaggataaattctcattcattcattctttgaaaaaaaaaaaatatatatatatatatatatgaaacccattgtgtgccaggcttaaacataccagttatctaactaccaaattaagaaaaaaattaaataaatgaattaataaattcttaataggtgaaaatgacttagctcttatcaattgcagggttcttgtcccaaagaaatatatctacatagcaaaatttcaggtgtgagttgtaggttggtgactgtaatatttggggcaggatgatttccaggaggcattaagattataccctatatatttctctggtttaagttagtattggaaaaaaagtactagaaaaatgtgaagcctgttttttgtacctgaaatatcaactccactggcagtttcggagttgaaattatttgaatatggtcaaagaaaaatttcaatggatggaattgggcaaggacgactttattcaagcctatcacagcaggggagagagatcagactgaactaaactccactgaaacaaaaggtgggagagttttaagcgcaggggtgagctaatggaaacgtactggagcaccttgttggaaggaagtgggagcagttgtcaatgtgattaggccatctgtgtttgctaattgtcccttattgaaggtaggctcctactctcccacagacactggggaattccttccttccttccatccctccctccctccctccctcccttccttccttccttcttcttttttttttttttgaaggagttttgctcttgttgcccaagctggagtgcaatggcatgatcttggctcactgcaacttccacctcctaagttcaagcgattctctagcctcagcctcctgagtagctgggattacaggcgtgcaccaccaaacctggctaattttttacatttttagtagaaacgggatttcaccatgttagccagactgatctcaatctcctgacctcaggtgatctgcccaccgcagcctcccaaagtgctgggattacaagtgtgagccaccacgccaggcctctgtcttgataattacatttcaaaggaatggctcccaggtccttggaaaagacattcttggggtataaaactgggaagagtctgggaaaaggggcagagaaagaatttataattccaagtcttctaaagtaaatactctaagaaaagggaggttaggaatttatagttgagaagtctatctaaagtttaataaagtggaggagaacattaaggccattttagtcaacatacatgttctttttgtaacaatttcaacatttttccttttagcaaacaaaaaaattttcttttggttggaaccgctgatggcaagttagcaatttttgaagataagactgttaaggtaaatgttgaatgcattctacatctaaatttattttaagtcttttgttttatatatatctcacacccctcttatgggattataaactccctgagagcaagaatcataaattatgctgtatttgtattgcttcataaaatcttgaacacagtagatcctctgaaaatacttgctgattgactgtatattttatatgaatgaactaagaataaaatgataaatgacatctgattgataatattgggaatggaaataattcaatttgtacataactgaggcagataattccttataaatatattgtggaaaaaaaacaaaaatatacttaagttttaaatatggcttgccattaactttttcttaagcattgaagaaatcatttaattttcttttcttcagattcctatttagtcattaaagcattcatttctctatccatctattcatctttggttccatctattcactcaacttcctacccgttcattctcctattgccaaaaagcttattatctgatgagagacagggaagtagagtataacccttaggttatttcttttgtaatttttacatgggaaaaagaatagattgaatgtaacaataatatttcgaatatgacctaaatttttttatgtataatatttgtacatatttatggggtacatgtgatatgttgttacatgcatagaatgtgtaatgatcaagtcagggtatttaggatatccatcaccatgagcatttatttctctgtgctgagaacatttcaagtctcctagttattttgaaatgtttttaactgtagtcactttattgtactattgaacattagaacttattcctcctatctaactgtatgtttgtacccgttaaccagcctcccttcatcctccccttctcccacacacccatatcctcccaagcctctggtaactatcattctactctctacctccatgagatcaacttttttagctcccacatatgagtgagtacatgtgatatttgtctttctgtgcttggcttatttcacttaacataatgacctccagttccatccatgttgctgtatatgacatgatttcattcctttttatggtcaaatagtattccgttatgtaaatacacacattttctttatgcattcattcattcatgggtgcttaggttgattccacttttttttttagctattgtgaatagtgctgcgataaacatggggatataggaatccctttgatatactgattccctttcctttagattagtatcagtagtaacattgttggattgtatggtagttctatttttaatttttttgagaaatcaccattttgttttccgtagtggctatagcaatttacatacacaccaatagcatatgggcattcgtttttttccgcatccttgccagcatgttattttttgtcttttttataatagccattctaattgggtgaagaagatttcattgtggttttcatttgcatttttactgatgattagttaatgttgagcattttttttcatatatccattggccattactatgtcttcttttgcaaatgtctatttagatcctttgccaactttttgttttgttttaagacagggtcttgctttcttacccaggctggctcacagtggcatgatcatagcttgttgcagccttgaccttctgcactcaagtgatcctccaacatcagcttcacgagtagctgggactacaggcgtgtgctaccatacctggctgtttattttttgtagagatgcggctccactatgttgtccagactgatctcaaactcctgggctcaagcaatcctcctgcctcatcttctcaaagtgctgggattacaggcatgagccaccatacccagccctttgcctacttttaaatggagttcttttttttttttcctgttgaattgctttttcgagtttcttgtgtattctggatgaatagtttgcaaatatttcctcacatttaatggatcctctctatattgttgatagtttcctttgctgtgcagaagctttttagtttattatagtcccatttgtctaattttgtttttgttgcctgtgcttttgggatcttaaccataaactctttgtctagaccaatgttctgaaatgtttcccctgtttccttttaatagtttcatagcttctggtcttacatttaagtctttaatccatcttgagttgaattttgtaaatggtgagagagtggggcctactttcatccttctgcatactgatatccagcttttccagcacaatttattgaaggtggtattctttctcccatgtatgcttttggtgcctttgttgaaaattagttggctttaaatatgtgggtttatttctgggtcctctacattggtctacctacctgtgtttttgccaatactgtgctgttttggttactctagccttgtaatatattttcaagtcaggtagtgtgatgcctccagctttgttctttttgctcaggattgttttggctattttggctctttttcggttccactcaagttttagaaatttttttttctatttctgtgagaaatatcattggagctttcatgggaatttcattgaatctgtagattgctttgggtagtatggtcattttaacaatattaattcttccagtctgtgagcatgaatatctttccatttgtttgtgtcctcttcaatttctttcatgtttttcaggtttccttatagagatcgttcatcatctttgttaaatttactcctaggtattttattaattttttgtagctacttcaaatgggattgctttcttgatttttcagctactttgttgttgttgttgtatagatatgctactgatttctgtatgttgattttgaatcctttactatactcatttatcagaactaagagttttttttaatggaatctttaggtttttgagttttaattttaatatctctaatcatttaagatggaaagtagttttttgaaagcacagattttatggagttttgttctgtggatactcaatttgctgagtgtgttttcttttttttttggcaaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgtaagttattttttatctgtacaagtaatttatcattatacttttgttttttccttataatcattaataatactgttgataattcataaggaagatcttttaaaatgcataatttattttctatcataaaattaaactttcattataaaaaattttgaaaattccagaaagcagaagggtatttttaagaagtcactcaacctaatcacttttagggataaaatatgtaaactcattgtaatcttagtagtatttatcaatctaaattttttaacaatttttattatctgtgtttcaaattagacatgaaattggaagacaatcaactttgtatttcaccaaattcacggactatacatatgcaatttgggtaacttccattaagtattgattgtaggaaagatagacagcaagtattcttgcttgtccaaagttgtttctagatttgataattatacagatgtctactcacagccaagttagtgataccagtttcaaacaagaataaaataaaatattaatataaacctctttcaagtttgctttttttcagtggtattttaatcaaatctttgcagttggttcttatttatcacattcctcagtgataagcagtataggattgtggataagagcataaatcatagttcagatattgctttgccatctattggttttgtgaacttgggcaataacctttcacatcttcagtcatctcttacctgaggattgtaatattctctatctcaaagagatatttggaggagtaaataagaatgttaatatatggatcttaattaacataatgaccagcacctggtaagctgtcaataaacattagctattattattattattagctttgagtcacaaatccctaccttagggaatatcctggtttcccattatccatcaaatttcccaagattggcacttgggagtaatctttgactcctttgttttttgctccctttatccacttgaccctcctaattgtcatttgaatctttgtacttctcactgttctcagtgctggtaccatgggccagactgccatccattatctgtggccacattaacaagagcatccagttctcaccctctgattatactctcttcaacatattttcagcattgcagacagagggacctttctaaaatgtacatcaatctgatgcaattttcctgcttaaaacccttcagtggtatcccattgtcctttatatgaagtccaaattccttaagacagcctactgggcccttcataattcagtgcttgcttacctgtctagattcatattttgcaagctttttgccatctgtgctttacccaaactgaaattgactcagatctctaagacaacctgttattacctttcacccccaacctttgaatgtggtcttctccttacctggatgactattatgccccctgcctatttcagtccaagcaccacttgctctgagtggcaggttaggtgactttgtgcttccattgcatctaatgttttccttcacagtagctataattgtatttgttaaagtagtttctcaataccactaaatctactggctttcaacattggctgtgcatttagaaaccactaggtagctgaaaataatatgatacctgggccctacctcagaccaattaaatcagaccagttaagcctgggatggggatcagattttttttttcaggttctcaagtgattctaaagtatatttgaggttaagatatactgcggagtgcagtgtattataagttcccatgaatgaggatttttatttctgtctttacatatttatttactagtatgtggttaacatttggatcaactcattctcattctgtaatacccacattttaaaaaatgaatgtaaaaatgtcttttattatttttatttttcaaatttaattttagattccaggaatacatgtgcaggtttgttacaaaagtatagtgcgtgatgctgaggtttggaatacaactgaactcacaacccagaaagtgggcatagtgcttgataggtagtttttcatctttgctccccttcctgtaatttccacttttaacccaattatacaagcctgaaaacctttaaaaagaaagggcctccagtttatttttttatttcatagcacattttatgggattatggatatcagttaactctttaaagttccatataagatttggagcatagatgctttactagagagcatccataaagatcaagctctcaaagatgctcatctcccaaaagagattgggacctagatgcataaacacttaaatataaatatttgctctcttctgaacaagtatctcctgtggccttggtctctaccccacaaaacagacatcacatcactaatcaggggttgcctcatcatcagtaccctcatcatcatcagtacacaccgactgagaggcatgttgggtaatgaaagatgactgcctttgaagccggaagactccataggacttttggagttctaggtctgcaacatgtttttagtcctaggtcggcaagcatgatgttagtcataggaccttgagcaaattatttagcatttgtacatgtttctttctactattaaaaacattgagatttatcatattttatgtttttttattaaggatcaagcaagataacacacaaaagtattttataaaatacggaaattccatgcaaaactttgtcctaattggaactattttctattaaatacagcaaatatccaagaaggaattacctaaagcgtagtggctctctgacaacacatcatatttttacctccttttccagaatagaaagaaaagggggaggaaaaaaaatcttcctactctaggatatactaatgattgttaaatctttatggtattttcatgttatctatctgatttaaatgcaattttgactatttttacatattcctcgttgttcattcatactgtagtgccttcttctattcccccacttaacagactgcttgattatatcagaggtgcttatctgtgcaactgtttactggacgaggggtatgtagaaaatacattgtcctcatccttatgaaattacactcataatctagtgtgagggatgcactaataaagacaattttatatttaataaggtctataatatgacagtgacaccagtggggaaaagggactggttggtctattttgataggtcagggaagaaatccagaggagccgacatttaagttcatcctcaaaggccaagtaggagtttgccatgctgatgtggcccaaggtagccaatctgtttgtgaaatatgtacaatgccagatgtcttaggttgaaagggaaatattttaaggtgttcgtaatttttctttatgtttaaaaggggaaaatggcaaatattttactttctgtttatgtttggatgatgtggatttttgttttctataatttgactggcttaactgcaaagatatcccttgctttaaaatttgaagacactgcaactaaattttatttcagcattttatattttataactctaggtataaaaggctaacacttaattttctgagcattcatgaaacaaagttttgcaagaacattcaaaagttacagatataatatttccttcagaaatttagatatagtacaaaattctacaaagagccacatagaattgaaactaaaagtaagaccaaagtaaacattggacataatctttattttattatcacaagaaattaatataaagtaaccaaaagtaagtaaagtaccaaagcatgttatatattcaattcagaatggttagggaagaatatgaaataattgcaatagtctagcttgtttagttttcaaaatagtgtttttacattaagaactaatataaggttgtattacacgtagaaattttaagaagaaaacaaatagtgatgactttctatttttttttctctgtaggttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaaggtaaattctgtggtttttaattttattcccaaaagaattatctttgcacttcatgtgtcacagaggaaggatttttcttcctttctgcctctgaatagagaatttttttaaaatgcagaaaaaaatttgtaatgcttctcagcaccatcttttcagatcaagaaaattttgtcttcagaacataaaagaataggcacataatgtgcatagttttctcatggtattacaaagaatgttctcgaatgaaaatactacattattgaaaatgagcatattggagtctctgctagctttgacatagttctgtcacagtgtcaaatatactatttataattaaattatgggccccaggattatctgctctaaagaaaaagagtcacaaaataatagacaaatatggggggaaatgcaatggactgaccgaggcgctaaggagtggggatcaagaccccagaatgagagcatagtgcttagtctgatgcagcctgtgagtgacaaatccatagcaagcacattctttctgtgctggtgctgagaaacaggaccattttcaagcttatttgctagccactttatatttttattttgttttgattttaccatatagatctatgatactcttgagaacattttagattacacactatatctgtaaaaggatacttcaaagtttcctgtcttagattcatctgacagtttttctatggattgtgagaagggctcacagtttatgttcagaagggccaacaggtctccttgataaagggttccttacttcctgaagtaccaaaacgattaggattcttttatttctggacacttcatttttgtcatgaattagactattcactggttctgggaaaaaattcagtggtttgtatcgatatcttttacatgtgaatgactataattttatgttcctttgtaacattgagacttcatgtaaaacttttgactctaacttttttttttctttatcctgggcacatgtatgctatttttactgaattagatagctttggtatttataaaaattgtatccctcttattcataatttcctgaaaatgaagggctattgttatctttgataatttatgcttcaagtaaagaagtgtggctctttggcatctgtatttagcaaaatttgctttgtataattttaatgatgcataatggtggtggtgtcatgttttaataatttaaaatgttgtttatgttatcatatgtaaatagcatttatctcttaattggtggtaaaattattaatgtatactttatggttctagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggcaagtttctttcctttagatatttttcatattctctaagtcttataaaatatgcctttattttacgtttacattttctctgaactttccagtgtcatatggatggtcttggagggtcacacagtgaaacataagactggtataaattgtgaatagggtcattacagaagtggagggagtaaatgctctcagtcccacaagagaagcagattactgcagctgaacactcagtttgggtcttacttgcttttttcctttttacctaaggcaaaaatgggaaatacatggtattgaatatattttactttttgagcaaagaaaataaagaaaatgtttgttttaatcatagtctagcctcccagcttgttaaagaatctcatttggtttttcattctataacaaatcttttttcttgcagcaatacatgctgaactgcacaacctacaaatattgacaaatcatattttactcaaactttgtctttttttgcttctatttttatatttaaatatgataaaattgtgatagcacataaaatatattttctgcataaatatatttgcgtcttcctttgataataatttgttttagaaaataacaataatagcatatatacaaaagtttacaaaaacgacactatggggtttaattctgaaaaaaactagaatttatgtaactttagcaaataatgaatgttttgaacatggtgaagaaaatatattcattgcaagtatatgtgaaagaggaacatgtgtttttctagcaccttcacctatttttcatttatagactttagagttgcacaggagttacaattagatgctcttaatgactgtaaactattaagatacatgtccacacaagcagagcagtaggtctctcaataggttgtctcagtagtcttattctaccaaagttgttgcattctctagttgaattgtatgtactttgggacccaaatagcttgcttataactgaagttatagtggaatgtctatgggttatagtttgattttaaaataaagatcaattggaggatagcctacaaggtgctgcatgagctggcttcactgtacctctcctgcctccatcatctaccacattcctaccagatcttgcttgtctagatgaacatccagttcttctcaattactatgctatattttgcctcagggatttgcacatgctgtttatttctttgcttagttaacatagctttttttcatgcttatttaactcatatgctttgaaatgttagctcctgtgtcaaaacctctgagaagccaacactgattaggtcaaagttcccgctttgggttcccataacagctttcttgcatagttttgatcatggtcatatttttttttcattaatgctagtctcttcactagaatataaactccaagacggttgggttagtgtgtttttgtttaccccttttttcccaggatctagcctagggcctacatagaagacttttgatgcaaatttgttgaataaattagtgaatgatttgaaaagaaaatatgatattttgacatagtatcagtatatccatccatctaagtgtccatctaaatactcatatttgtactaaatactcatatttgtaccttaccatatccaaagaacttttcacacacattacctcgtttaacattgtaactttgggaagggtaatgtataaatactgagcctattttatagaaaggttaagctgttttctcagactcacataattaagaattgcagcaaggagtggatcacagattttgttattttttaaaaaaatgctggtctttattcaatataattgaagggtcacctagaaaatagaattgtgaattcagttccaaggtatttgtgtcttaaactatgaacaactttacttttttttcaggccagtttaatatatagttttaacagaaaacttacatattttgtttttgtaaaggaagccttaaaaatgtcatgctggtattgggctacaaccggaaaaatactgaaggtacacaaaagcagaaaggtaacatttagaaggatactgttttccaaacagggcaatgatgtgaatgatggtaacatattatgtgtttcataaatttgtagaaaatattacatatggtataatcaggaattttaattggtagtttatagtgtaaagaacttagacataaattttcaaaattacaagtgatatgaagtgttaaatatttatattttcagctgaagtagaggtgtcaatcactagctcaaccttaaacgaaatgtgaatattttttacaacttatctatatctacataatgtctaattttgaacagtgtttgaaaaagcttttatttcttttagaatatgaaatgttaatttattaaatgttgatactctatttgaaatttaatagtttctataatgtattataaaacttttccaagtatagttttttataaataataatttagtacattagttatagctgtgtttatatttacatttatctaagtcaactaaaaatacatgagccaaactgaaataaaataagaatgttttatgatggatctttgaaacatgatttcatttttttctttttctagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaaatgcttttaagcatgtttatgaatttttaaactttgtgatagtgttttgcttttcacatataggtctgttatccatctcataggaaactttgtattaatttgtatatgggacattccacaataagaaagtgcaactaaagttttttccttgataacttatggaatatttaaatttaattttctataatacatatagttgccaggatcccaggacaaaatctgatgggcatgatacattctattttcaagttctcttaaaaagtttttgtaagtaaacttgtttgctcttgagtactgaaacaaaatataagactttagagcaaatgacatatacaaaaaaaaggcacagtcacttcaactgttttctgattagaagcctaaaataacttgctaattatgatcaaaatacaagcatattatcgtaacaaaatattcttttgggaaaattttgaattaagaaaagggagcctctttgactctaattctggtaggtactctatcgattatgtgtgaactatttcaactaaaacgcaacttatttttcatcaaggcagtgaaatatattgatgaaacatagcagaattaccaaaaaaagattgtcaattttcctaagttaaatgtaaggatgcaaatgttctaatattgaggggagataaaattcaaaaccattgggactttgcttctttatccatcactttgggtagctgaacacctaacctggtaaattgaatgtttttcatggaggcttatcagcaattcagtaaaatagtaaactatgtcaactcgggagaaactgacatcctcattctccatgctagccagtttctcatccagggtgtcattgtttctaataacaattcagaatctggctgcttaaaggcacctacgtacgtggttctttctaatttgtcaaggcatttggagtgatcctatcaccctgatttcaagcaaaagacagggaggcacctgacccaaaggcctgctgtctgaacacactctgaatgggtgagcagagatgtgctttaagatagaacctaaggtggttctctctatgtgctgccctcacactgctcttgatttctacccttacctgggaagtctctacttgatgtctgtcttaggctaagaaaaagagaagagaaagggaatgagtattagcatctggattctggggctgcttcttggcctctgtgagaatccactgtttcacagcaatcacagcctagaaaactagactttatggagtaaacaataggtatcattctgacctgggcttcaccacaatcacccactgaacactcccaagagaaggttgttaccatttatttatgaaaataccaaactatgtgatacatactctattagaagtattatggaaaaatagagaatatgtctacctggccagagaatagaggatctggatcacaaaaaaagtacaaatatttaagcagagacttaggacaaatgggcattcaacaatttaggacacatgggcattctacaatttccagagtgaagtaaacattctaggcagataaatcacacatgtgctgtcttaggaatgtgagcttattttgaaagcatccctatcaaatacgtgctaaaacttgtgacaagttcccattcctagagtacttacaggatacacttaagtgactgaagatgcaagagaaatatatatttgtgtatggatatagcattttatcattaattgagagattataaagctaatgagcttttctttgcagagggagtatttgttaggatgaaatggggagagatgtttcaaacaccaagtttatcttataggttaagaaatcctagaaggaatccatgactttatgtatatatacaatatatgacaagagatttccccatctcattacaaaatgagcacaaagtaactaactcaaagcttttgctattatgataaaagtttaaaaggctagtacatagcagaaatgtgatttactataacgggggtccaggggataaaatatttgcaagctgattgtctcatgttggcaatgttttcatttcctactacgttaggtaacacagatgagattgtacatcagagtaagaaggcaaccactaatagaagctgcatgcgggcaaaagactattctctgaccataagcttagtttagatggatccttgctgcaatcactaaattcataaatctgtgctagtattggatcaggaaatctctgcacaagcagataaataaaaactttctgctttggctgaaataactgcttttaggaaaagaaagagtatatgcttattaatatagcttgggatgtggacctctttgacgagactatacaattcaaggtagacaaagtatgcctaaaaataaatctaaaataaacttgtatattcaaatggaacatattctttaataatgtcatttttaagggctctgcatttattccataaatgctgccattattgttcagtttttcttaattacctgcattcactttagaaaacagaaaaaaaaaaaaaaaaaaaaaaaacagaaacagttgcaaaagaaagcagccagaaagaacatacatttagaattgaaaaagaccttggtctaaattctagatttggcat

SEQ ID NO: 3 - DNA, 149001 bp, Macaca mulatta
  source 1..149001: mol_type = genomic DNA
tcttgtttttatgttttcttattcaagattatataactattaatttatattttatttttgaagttatttttatttaactttttaatctatctggagtttgttttgatgtttgctgtaattagaaatgccagtattatttttttcttttcaggaagttagccaaatgttctagcaccattttattctccactgagcactgcttccatcataaatttgtgcctgtaatcttcattttcagtcttgttaactacctgaagagttgataaatcttggaattttagtcagtcaattaaacatttttgaaacctaagagaatactttaccttaacactgcagtagttcatgggagaatgctcccaacagataattcatattttcatactgcctactcacagtctggccaatatagagtagataataaataggcaatagatggatgaatgaattgtggaaattggagacatctttttttttttttttttttgagacggagtctcgctctgccgcccaggctggagtgcagtggccggatctcagctcactgcaagctccgcctcccgggttcacgccattctcctgcctcagcctcccgagtagttaggactataggcgcccgccaccgcgcccggctagttttttgtattttttagtagagacggggtttcaccgtgttagccaggatggtctggatctcctgacctggtgatccgcccgtctcggcctcccaaagtgctgggattacaggcttgagtcaccgcgcccggccggagacatcttttaatttagatttattttgctttggaagggaggtaggttttaatttcttgcaaggttgtaattcagtagaataggaagggagaaactaatgcagaggaacagaaggaatgcatgagatcgagaatgcctagaaatatttgagacattgattaagtcatcagaaatggaaacaagtttagaaacaacttagaaaagaatacactgtaggtctgataaatattgttaagattaggatttttttttttaaattatggaaaatgttatacagacagaatagtagaacagaccacatgaacccatctcttattatcttcaacaattaccagttcaaaaattgttattgttatctctgcctccacacatttcatcttttcctccaccactggatgactttgaaacacatcctaaccctgctaccatttcaactgtaaatatttcagcatgtctctgtaaaaactgaagactctacaacaacaagacatagacctaatatccaggttaagtaggaatttgttatcttactaatctgatgaaaaaacaaagtctagagcatttttattaaagtggtagagcatgaagaaccatctaccgggtgttaggagatttgcctgagttgaagtcctggctctcaacttcccacctgtgtgactccagcaaagctcttcacttctctactccaaatctcaatttcctcattagtgaaagaaggatacatagtagtagttttatccatttcagacttgtcatcaggattgaagtaacagatgtgaaaacaaatctaaaattgtgaagtagtaacttccagtccaatcctcttctttttaaataaccttgaggacagacacatcaactgaaggatagatcatctttgcctagccttgtttacaatgttcttgctaggtttctcttcctaaaaacacattacttaggtacttaacagaacaaacaatcaaaaaacgaaaccaaaaaactttggggttatagacacccatactcataagtaattctgaatgccaagagaagagtatttcggtttgcttctctcaccttttcacctttcatttcatgtaccctgtcctttgtctcagttctaatagctctgagagctgattacttttccggtgtcccacgtatcaggatcctgcctagtgcaactcaattccaaaagttaatttagtggccttttggtgaccagagcttcagataactcacagggaaacaatgtttatttcctctcccactaacagtcacaacaataataaaaaagacagtagcggggcaagttttgatggctaacctctctctccatcctttaaggggagaactctataaagagaatgttttcctaaaggggccatctgggcggtgtcctctttttcccagcgccctgatttctattcttagatctggagataggcggctttcatttttcctgctgccagttcccagaccttccctggggccgcaggatccccggctggcgggtcgaggagggtggccggccgggctgcgcactgcgcgcctccgctgcggggctccgggccttgggactcggcggagtccgctgagtcagtttcttcctgcgcgactccccgccgcgccgccgctgtggtggaatctggtcccaggaggcggcgtccgcccgggtccagtctaggcgtgcgtgggggccacgggcacggtcatcccggccaggcccggctccagcagccccacggccgccgccgaagttctgcgcggcccgtcgccccggcggagcctctggcaggcccctgagctggttttttggggcctggctgggggaggaggaagccgagcaggagggctctggagagggagggcaacgcggggcggggagccaccgccttcctcataaacaggcgggcgtgggcgccgacggggcccccggggagccctggctgagggcggtgagctgagctagatcccggggagctgtggccggcgcccctgccggttccctgagcagcggacgttcgtgctgggagggcggcgggttggaagcaggggccaccatggctagtggcagctgtcaggggtgcgaggaggacgaggaaactctgaagaagttgatagtcaggctgaacaatgtccaggaaggtaaacagatagaaacgctggtccaaatcctggaggatctgctggtgttcacgtactccgagcacggtaatcacttgcgaagaaactgtgcttttgtttttgcaaactttcgccccctcctcacatttgcaaactttgtcctcctccgctgacgctgctcaaacccggactcttaaagagccgtaaactcccatctcctttccttagggcggaaaggagctgagaattccaggaaggtcttcacctttttgacttttctccccttttcagacttaaaaggaaagggggtgctgtggattgtgactttgcttcttttccccacccacttgttttccagcctccaagttatttcaaggcaaaaatatccatgtgcctctgttgatcgtcttggactcgtatatgagagtcgcgagtgtgcagcaggtaaaggcattgttttcacttcaactcattcgcccttctgtttggaaggagacgttttactggcagtgttatatagccgggagttcttggttattctggaaatttggcttgaggaacctccgactgtgattttcagatggggacattgttaaatattttgatcatgtaaaaagggatgaagggccccagtatgtgttccctgagtgtctttaagtagtaactttataaaaccgacagtatgggtggtggtagaagggggataaaaatgggttcgggtttagtcccgttattggcaagatgaattaattactgtttagacctgactattccaggaatcttcccaatgtagaacatgtcctagatgagaggattatgagtagtttggaaaaggggaataactaatagtgataaaatgccactttgtcactggcaaactcttgtagagttcagcatttcttaaaattcaaagacagatttctagcctttagttttagtataccttgtagtatctaaagaaagtcatgtcttttgagaccctcataatttacaactgttgtcgtataaaatgcatgtaaaactgaaacttttacaatctgtaccacaggaaacccagaaatttgctaaataccttggatatatatttttttaaggggggctttaaaatggtaattaagaatgatttacagtcaaaacaaaattataggccaaagtgataacttcctttggagtacttagagatttggggaactgaaatcagttttgtcatctgcatgttaactcatgcaaagaaagagaactggactttgaactccatggaggtgcagtcagaaagccaatgtttcttaatacttgagaggcttgacagaggtaaggcatctcaatctttaaattggtgtgggtctatctttatctttatgcttatctctgtatctagctctatctgtctgggtgaaccatctagcttctttcatatgaggacatttatatctggaagaaatattttaatttgttttcaactgtgaaatattttccatctgactgttacagattttcacaccactatcaaaccaaaccaagaaaagatggaggcataataaagatgctgttcttttaagactcaaagtcggaattttgcctgtggaatatgagtcactctttgggcaatggcctattgtgcttcctgctctgcacccacgtcatcccttcttgcctctgctttggtgttcggaagtgcctggttctggccactttcattccctagactctgtacttcatagagtcacttctgcttgataccgctcaggacagtcagaccctaggtaggctttggtctgcaaggtctagataagggagtgctagacttgagaacccaagggactctggaacataccacctaattcttaattttagaaattgcacaagcctgagcatacttgtctggagtagttatgagtgtgtcactcagtatttctgcccagaggatactggaggcaaagtatgctggaaaataaggaagagtctttttataagtaattaattacttttttggatgtatcatagttgtatatgtttttggggtacatgtgatattagatacatgtatacaatgtgtaatgttcaaatcagggtaactggactatccatcaccttgaacatttttctttgtgttggcaacattacaattcctttcttctagttattttgaaatatgcaataaattcataatttccctactgtactattaaatacgaacttaattgcttctatctaattatatttttgtacccattaactaccttctctttatccctccccatcctttcattcccagtctctggtaaccaccattctactctctccctccatgagatccaccttttggctcctacgtataagtgagaatatgcaatattttatttctgtgcctggcttattaaatttaacataatgacctctatttccacccaggctgttgcaaatgacaggatttcattttttatgactgaataatattccattgtgtatgtatgccacattttcttttatttttagttaagtaattaatttagagacagggtctcactctgttgcccaggctggagaacagtggtgtgatcaaatctcactgcaggcctgaaatcttgggctcaagtagtcttctttcctcagcttcccaggtagctaggagtataagcatgtgccaccatgctcagctaatttttttttttctttttttactttttgtagagatggagtcttgctatgttgcccaggttagtttcaaactcctgacctcaagcaatcttcctgccttagcctccatattttctttattaatctgttgatagacatataaggtgattctgtatcttaactattgtgaacagtgctgcaataaacatgggagttgagacatgtgtttgatatactgatgttctttcttttggatatatacccagcaatgagattgctggatcatatgaaagttctatttttagttttttaagggacctccatattgtttttcataatggctgtactactttatgttcccatcaacagtgtaccaccattcccctttttctacatcctcaccggcatttgttattttttctctgtttgataatatagccattctgtctgtggtgagataatatctcattgtggttttgatttgcctttccctaaagattagtgatacttaggattcttttttttcatgtatctgttagccatttgtctgtcttttgagaaatgtctatttggatcttttgtccatttaaaaataagatttttttttttccactaattgagatttttgagttccttatgtattctggttgttaatcttttgttgagtggttattttgcaaatattttctcccgttctttatgttgtcttttcactttgttgattattttctttgttgtgcagaagcttttagcttgatacagtcccatttgtctatttttttttgttgttgcctgtgcttttgaggtcctaccccaaaagtcattgcacagaccaatgtcctgtagtatttccccaatgttttcttctagtagttgcacagtttcaggtctgagatgtaagtctttaatccattttgagttgatttgtgtatatggtgaaagctgtgcatctagtttccttctctggcatagccaatatccagttttcccagcactatttattaaagaaactgtcctttctccattgtaggtctttggcacctttggaaataggttgcctataaatgcatggatttttatctaggttctctattctgttctattgatctatgtgaggaatagtcttttgatttggtaatttaatgcaatagaattattaatttcagtaccatatgtgtataagtctataaagggcattgcatatgacatgatttgattcttactgaaatctcactgccctctcagaaatcttaccggatggtttactctcatagctcagtgagagtaagctactaactgaggatcaaagagcttgtgacaaacctgagacccaagtcttctcacaccttcaaaatctctttccatcatacaatctactagctgctgaattcacaagctttttgtgcaagctcataaaaagcaaaatggtttggtttttgctttggccatgctaggtacaatgacatcaatttaaattagcattggtcttaccaaggggatgtagaaaggggtctcctactgacattttaatactcacttgaaagtagtgtttttccttcagatttctttatataattagtataattactgtaagtatcctttaatgttttatatgttgagttagctggaagtgccaaattaaaaactcttaatgatgaatttaaggtattaaggtaaattactccttcatttaatttaattgtaattgttaattactatttaaaataaagattaaggtttgtttctagatgccatttaacatgatattccgggctgtcagttttattttcgaagtttatttcatattttattaatgcttctacataaatgacagtctttagaaaattggtagttaagctgctttatatttttcttttcctgcccatcgtttcactgtgctcctaaattttacatctctttattctcacggtttcaaccttgaagaaggggagcaaaataaatgaaagtggctaaaaatttttctttaacccctagactctttcctgttgtgccttaattacatgcttgagtttttagaataattataataaagtaaaactaccaatttaattgtattgtaaccgtgcaggatgggaaatttctctctttgaaagataagcttttaattgaatagattaatggatcaattgttacctctgctttgctgccagagattctgtttcatcacagaagttccatgtagtactggagagctcagttgcctgaatctttttgcaaagcacttacttatgctgttgcttcaccaaccagaacaaaacaggttttttccttgagtcagctttgtaggtatagggatgagtttggcatcctatgtgatttttttcaccaccagaagctgttcagaatgttattttcttaaatacttcggaaaaaagtcttgatgtattttatgaaagcacaaaaatagttggtttctatgacagctggattgtcaatgtctgttcagcttacgtggaggaggatgtcctacttaagtagtataggtagaaatagctgtcagaaattgctgcctttgaaagcaatttgaaattatgtaaaaggaagtaatgacgaaataaagcaatttctgtttaatctggaaaagatccaaaagtaatattgtaaagagatcttgagtaatcatttttatcttcctaaaataacccttgtttactcctgcaaacaggtaagaaacttgtgccattattccttattggatgcatatagatttctcaccttgtcattcaactccttgcaatgttcaactttacttatgcatccagccttatcccaaaatagcctctttcctgtagcggcttccttattatgtagcagcctactctcctcaccactcaacagttcttatacaatctgactcaagctctccctcttcatattatattctctgagtaatttcaactcacactgaatcttactttcagtatttctattgtattggtatttattacacatcacacttaggtacttttccataagtctctagagggtggtgtgtgagtgtgtgtgtgtgtgtgtgtgtataaatgcactttctttttttttttttgaccatgtcaagtatagttctatagtataatagaattggagatcctttacatttagagaggagtctacaataggaggagtaggttaattttaatctgtggtttgaaatcaggactttcaatttttttttcagaggtaaagagcaacttaggcaagttggcatcttgtaaacagactgagtgaagatatacttaaaatgcatccataatttcatattttatttcgaaatgtgaaagagcctactaggggtgtctgtatctctagaccttatcaattcattctagagaaatctagagggagccattgaggagttctacctcctgtctatgttatagagccctttcttttttttctcctatcagatgtagagtcaattgctaaaaatgccacgtttcttgcctctattattctagcttcattaattggggagcagccattctgataacttacattttgctactaaaattttcaacttgccctaatccttcattttaagccacttcattttttcctataattaaaaatttaaatatgtggaggaaattctgtcaggtagctattacttaaaacctactaagggccaggtgcggaggctcacgcctgtaatcccagcactttgagaggccacgtcagaaggcttgagccaaggagcttgagaccagcctgagcaatatagagagagacctgtcttcacaaaaatgttttaaaaattagctgggtgtggtggcacatacctgtagtcccagctacttgggaggctgaagtgggtggatcacctgatgccgtgagttctaggctgcagtgatcggtgattgtgccgttgcactccagcctgggtgacagagtgagaccctatctcaaaaacaaatcaaaaccaaaaaaaaaaaaaaaaaaacaaaaaaagaaacgtactaaggatccagtatagccgttcttgcacttaataatcttggtacaacctctaaaactattttttgtagtttattttattttgccttagacaataggcgtgtctatgttcttcaaaatttagaaattatatatatttatgtgtgtgtgtgtgtgtgtatatatatatatatatttttttttttttttggaaatggagtcttgctctgtcctccagggtagagtgcagtggcgcaatctcggctcactgcaacctctgcctcctgggttcaagtgattctcctgcctcagcctcccgagtagctgaggttacagatgcctgtaaccttaccaccatgcctggctaatttttgtgtttttagtagagacgggatttcaccctctgccatgctggtctctaactactgacctcgtgatccacccgcctccgcctctcaaagtgctgggattacgggcgtgagccactatgcccagccgaaatgttatattttttgtatgtctttctggtctgatttttggagaaaggtgtatcctaaggatatggcttgcttttgtttcttggtaagcattttagggtatcattttgttttataacaattatttacaagtgagataagcatatattccactaagactgaagagattcatgtttgactcagtatgttctattaacattctttaaaacacgtgaatatatgtctttcttgttttcaggtgggttggtcacttctgtgcaaattaatagaaatctgcccgggtacaatgcaaagcttaatgggaccccaggatgttggaaatgattgggaagtccttggtgttcaccagtaagtatgatagatatgtaaaaacaaactgccttgagtatttatctatacacataaaaaccttcccttgatacactgaatttgcaatccaaggctactcttgtgaaattctttgaaatacagatatttttccttgagtcaattatttacatttatagagagctttaaactcagaagtttgatttagaaagcaaacatttaaggtaacatgtcaggagttattttaataatataatcatataattataaaactggttaacttgtagatttttgatgagtacttttgcattcaaaccatgaagatattttgccctttaataatagaactgatacaaaccactagttcctaaaaaaatgggaactgagaaaagttagttctgtacgtagtaatttgaaagttgatgttctgtctttaaatggtacatttatatatattcatatatatacacagtaagtttaaactacggctttcaaaaagagtaagaaagaggaaattacctttcagcacatctgcagccaaatcttgatgacaattttaccagctatgtttttgcagtttgcagcataatgacttcttaaatgagactacttccttagccacaattaattaagaaaaccttttctgaagaagaatgtgttttcaggaaaatacattatttcttgacagttaaaaaatatcttctcagctactcgggaggctgaggcaggagaatcacttgaacctgggaagcggaggttgcagtgagccgagattgcagcactgctgtccagcctgggtgacagagtgagactctattaaaaaacaaacaaacaaacaaacaaacaaaccttctgtcattaactttaaatcttttttatacgtaatgtgacttttctttaccacagaaaaggaaattgtgaatatatctggcttacaatggtatgcagtttatgaaaatttaatttatgaaaaatttttaggtgtttatattggtgatcagtatcaagtagtgctacaaatttagacaaattagagctatatgtttggccataagtgaacatatctgtgcttatacattttcccctctttgacaaatgtgttgctcttcttgttttcagtacataaagggtgtgtttggaaagagcatatttacaattaattggagttctcatcttcaatctaatctttgtaattctatgtttcagttctaaagtatacagcttttgatgaggaattactcagaatataccagtaattagcaattgtaacttttaagtgtcccttggtttggttgagaatttccaagatgtccaaagatgagccagtctataacctcagggagtgtttgggaaactcatctagtcatattcctgttcaaaccagctgttcaaattaaattacataaatatttatataggaaatttgttcactcactcacttactcattcactcactttgttcatccagtcattcatcttccattcatcaaatgttttttaagcccctcctctaggccagaaacaatgcagttgtaaagaagatagacacactgctctctccagtggagtgtattaggtcactcccggcaaaaattgattgcaaaacagatttctgttttttcaaggccttttctctccaaagacttaccagttctgaagaaaaatttcttccgtggtggtaaagtcaggaagagtgggaatggtacagggagaggtaggggcagggtgattaggaggaagactggcagagaattgaagactggcttcattcagttcctccaactgccaaatggagattatgcaacgtatcttgaatacgtacaaagctctagatgtggtcagctcagtcttttcccaacaattcgccaaacaatgctgtgcaggaatagactagagattatattttgggattaataatatagggattaaaatctcatgaatttgaactaaacattattgatatgttaagttcacttttttttttttttttttgagacagagtcttgctctattgccaggctggagtgcagtggcctgatctcggcttactgtaacctctgcctcccaggttcaagtgattctcctgcctcagtctcccgagtagctgggactacaggagtgcaccaccatacccagctaatttttgtatttttagtagagacagggcttcatcatgttggccaggatggtctcgatctattgacctcatgatccccccaccttggcctcccaaagtgctgaaattacaggtgtgagccagtgctaccggcccactttttaatatattattaatttctcttttaaaaacagtagcaatcaataatttaaatattgaaatgaattcttaatttatatacacaaactaacatctttatatctctctatattttaatatatcaacatgtctaagataaattataaatttatatcacatgtaaaaatgggtttgctctcgatgtatataagacttcatgatattttgaacatggagttgggtgaaaatagtgaatctgaatttttgaatttgaatatttattggaaaataagtagcgcttttacctttttaaatgagacacataatagttccctgttgattttttgtttgtttttttaactttattagagttgacaattagaaattgtttatatttaaggtatatagttgatttgatatatgtgtatattgtgaaatattaccacaatcaagctaattagcattccctgttagtttttataagcctgattcaggtttgtagaaagaaacaaacacacatggccaggcacggtggctcatacctataatcccagactttgggaggccgagacaggaggatcacttgagcccagaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcactatagggaattaaatacaatgagagtaataaaaaataggtgagcaaaaaaatctaaataagcaaatttctgagtatgatatttcattcttatcttgatttctgtttttaactccagattgattcttaaaatgctaacagttcataatgccagtgtaaacttgtcaatgattggactgaagaccttagatctcctcctaacttcaggtaatacatgtatatgtttttcgtgttgattcagtttaaaaaaaattgatgccattaacttaaattttttttttttttttaaagatcaggattagggtagcttgatttaaatgtcgtaaaattgcatctttttttagaccttgtgatgtgacagccacaatgtaatccaaatatcagttatttccaaaattctttctgtttccatcttttctccttatctcttttctctatacgttgcctctcaaaaaatctcattcaataccttggttttaaacattaccttatatattgtccccaaatctctgtttgtagcctgatgtttgctcccaaaatctggacccacatctcatattctccctaggttagtggtcattcatgcccttgcattattacttctttctccatatatatcttgaatatattttctataatgtatgttctggagtatgccataatagttacattttgaaaatacataacattacttcttgagtatttgctagatgccaggcttcacaagtaaaatgcttcacattcttttaaacacctaaacctgaaaacacccctcgtgatagggattttatctcagttttctaagtgagaaacactgaaatgcagagaagttgcttcggccactaagtggtagaaacagggtctgattctccatgtcaggttccttccctgagaaaactttggcctggaaaataacggacctgaaaacaaaaaatcttgaaatgatgcaacagttgtgggcattgctgtgctggacactggctattatataagtttcttagaagaaaggctgctcacagggagctaatcttgtagggctgggaggagtttccttccctgtaggggagggctttttaggttgagagaagtatgggtgcacaggcctgggagaatagcataagagaggctggacatgtgattgggaaggtttgaaatgtcctcatcagtccccatcagtcctgctaagagatgaagaccttgctggagaaagaggaagatgagagtatgagggaaaaacaagaaagtactcagcatttcaccaccgctttttatgaccatattgtatggaatgcactaacagtcttaaccatgatttaatttaacctcatacttgggaggtattttttttttttttgaggggtattcattcttcatttggcaatggacaggaagatgagggtttattaatctgaaaaatctctccacactggaatatattaaagttagcctcatacagtactaccattcctattccagtattattatttttattgacagaatagatgctgtttgtgttatgttttggattatgataggagatgtttgatatagtaaaagacaagagtatgacaagcagttagtccaagtacaaagaggtaacaaaatatttagtgaggaacagtgtttagcatatttggagtgaagacaatgtgcagagggataaggggctgatgagatacatgtactatagtcagttgtgtgatgggtcttgttttttcatactaaggagtatgagaagatcttagaagattccagcaagggatttgcaagaccacaattgtgttttagaaatataatgcaggcaataaactagttgggtagaaattggggcctgtagagcaattaagcatctgtttttgcattctagatgagaatgcaaaacacaataggaatgaaggtgccttgttcaaaaggcattttgttcagaaggaatcttcaagatgtgtaggagatatacttaaaggacttggtaacgaattgatgtgttgtttggatagagaatgagaagagaaaggatggtggaaaaagaagatgactcaggagtttctcttgggtagctattggattatggtatcattgatgaagacagggaacaggagtagaccaggtttggggtacctgtagaatattcagatgatgtctaagaggcataagaatgtatttcaggtgtttggggcaagttatctagggtagaagtactgattgggactcatgaaattgtaataaagtgaactgagaatttatctcatttataaagatctagagcttgataagtctaacatctagggcagttaagtggtttgtcaataaacaaacaaaaaaatcgtgagtctacaaaccattcacagtcttcatgtaaaaattaacacattaaatgttaaagcagatctttactcagagcatattattctcttcaaaataggtaaaatcaccttactgatattggatgaagaaagtgatattttcatgttaatttttgatgccatgcactcatttccagccaatgatgaaatccagaaacttggatgcaaagctttacatgtgctgtttgaaagaggtattttaaaatgtcaaattccttaaagtatatataagaaaaaaaggcttatactgggaaaagtagaacacaattataagaagaagaaggtttctaaaatcctactattaagaagggggagttgtctgtcaagggtgaggaatggggttaattcagcagtattgcttgttttggtggagtgaattgcattcatgggttataaatcatgccagtggagtagactttcttcagttgcataacaaggcataaggtttactttgaaaactggatgtgtgggtgttatgaaagaaaaaatacaactgaagccaagcataggttacatcgggattatgatgttgagtcatcatcagaagtcttagaaattgataaaggctctgcataaagagccaggaggtttacaaagtgtccctcaggaaaaagactaatatgcatttcatagcctggccctgagattggtaactgagattgtcatgtaattttagagttggttggagtccttgtttagtctttccattgacctgaggaggaaatgggtcacagcagtgaagtgagcatcctgcctcagggcacagagcttgtgacagtacagttcaattagcaattattttgagagccccttttgtatcattatgggagccaaccgtgctaggggtttagataagaatgatttttgcgggccctgtgtcagttatcagtttaccagtctaatttctcgcagttcccagaatgggatagatcacctaataactgagacagtttcatgatgttcttcacttgttagaaaaacttaactgatttcgcattatattatagggacactggcataaaattaaaaaaaaattaatgttgatcacttagagtgccgtattttctaacatatttctggcaccattctcaaactagataaactagaattttatacatgtttttgaggttgttgcccaataacagtgactccaaatggaacttactggcttgatcaaatgactttaattgtgaaaattaatgatctatatttttgctgtctgatggaaaatcactaagacagagtatttcaaagtctgattacttgccatttgctcaagttgacaactcttgaactgaaacatttagccgagctacccttcagcagcctaccattaatgcctccctttcaaatattgtaatatgtccaattctagttgaccatctttattagtcactgtcagttttctctagaatttcccaaatgaaattgtaaataattttgtttttctgagaatgactagcacttttacatttcaaaacattgagtaccgaacatagactgaaacaaaattattttaatctctgtagcttgctttcccattataacattcttaggaagggctgttttcacagaaatatattttttatttaaggagattacatttttttacacaactatcatgaatgttgtaatttttgaataattaaacttctgtatcatctttaggcttattcagtattttgtctttcattttttagtctcagaggagcaactaactgaatttgttgagaacaaagattatatgatattgttaagtgcgttaacaaattttaaagatgaagaggaaattgtgcttcatgtactgcattgtttacattccctagcaattccttgtaagtagcatttatatgtgatttctttttcgtatctgaaaaatcacaatatatctctttctgagtatattttaacaatatttttattatttagaaacttgtggatgctaaacccattcattcatttatccatttaattaatttacattaattgacactatactgaagttggctgtgggcttggtgctggagaaacaatagtggaaaatacaaatgtgttccttaccttttcagagcttgtagtacaatgggggacacagataagtatagaggtgattacaatggcagaagtgatggcagaagtacccagagttaggagaacaaataggaagtgaggcaatgtctcttagccaagattgaataagtagagcttcctgtgcacagaggtgtgagctgaagtgagagtgcaggcaaagtggcccaggcagtgggaatggttagtgtaaagatgctgtagcaagagagagcagactgccttcaagaagacaaaagtagctcagtaaaggtgtggggttatgagtgtgcatgcgtgcatgcgtgtgtgccactgtgcatgcgcatccccaaatatcctgtccgtttgtgtttcattgacagaggcaagggagaccttgataagaggcagtgggtgaggccagagacatggagtggagagcatgaagggcctaaaaagctgcatgaaggagtttgaattttattgtgattcttgattagcattttaatgatgctttgaaatttagccacctttttcaccaaaaaatattaatcagaagaaattaatttgatgtgtatgttaccaatgattactaataagctaaaataatggctcatattctgttttgttttgtaaatgcccattaacactttgtatttcatgtattacttgtgtgggtttctacaggatatacatatgcatttatctagtgatattttcatcctcacacatgtgaagttttgaggattcaacgagttaaaaatgtagagtagtacctggcatgtaataagtgttctaaaatcactgacaggattattacacaatatgtattttatatgtatgttgtatactatatgtaattgcatttatggtttcagatatggaaatcactgtgtcagtctgcaggtgtgagccttcagtgtaggcagagtaaaaacccaatgcccttgtgaaagaatgccttttttttggtgatgtttataaaatcacaacgttttcttatccacaggaaattaaacactagaaagtgggtgggactgaacaataatagagaaaggccatgcttttacatttctctgagtcatcattgccaacaaactgaatatatttttcattatacttttccttggctatatttattcatttatttatttattttgggctggcagtttttggaatccattgttttccacccacatctgacataactccagtaaaaatgtgttgattcataatacaaaagtcaaagaaagtggcagctaaaaattaagactcaagagtttttaaagcactgattctaactgaaaaacatttgcttttcagtctttaagtctattgttttgaatcaaagcaggtaactcctttaacagaccatttccatacattattaactttttttctatgtttaagcattataagacactttttgtgaaaacagttgattagttttggctgtgccaaaacagatactaaaatgttttgcaaacagccctttttaaaaaaaaaaaaataaaagaacagttaacatttgatgcagaaatagacatattttctccatgtaggttcgcacttcactccctttattgattcattgctttttctggtagagtctttccttcctttctgtttcacctgtgtttgtcccttagacttatattttaatattgtgcctcccctttttccttctcccatcttttcttccacctattttggagccttcaggaagctttattttgctgccttgtacactggttgctctcctggaatggaggaggaaacaggtcataactgattttaactcttctatctggtgacatattcttgattttctttcttttggttgggggaaaaaaaatgcaaaagttattatccagtgaggttgagcctcgttaagaaagagaccctccaatttattttttgaaaacttagaccaatacattacatttctagactttcattttcagtacttttcatttcgttttcagtactaaaagtactctgaatttttccttttttttgatcttaaggctttaagccaagaaacaggaaagaagtaaatttttcttaatgctaaagatgagtcctacattccattatgttatcaatgaacagcctagaattttttacagctgcttaacggaacatgatgtttaaatttggaaatgcagtcattatgctgccatctatttacaatctatataagacatctttgtatgcatatttcaaaggggaaaatggttaccttattgataattatgatctctttaaattcaggcaataatgtggaagtcctcatgagtggcaatgtcaggtgttataatattgtggtggaagctatgaaagcattccctatcagtgaaaaaattcaagaagtgagttgctgtttgctccataggcttacattaggtgagtttcttagttaatatatcatcacaatctgtatgatatacatatatataatatatatgttgcataatgatggataagtagcatattgacatactttgaatgaaaatattgtaaagtcccagaaaaaaataaattaaaaaaaagaaaatactgtaaactaccaaaccgttttgctatgtttagatggacttttaaaaggagtgtcaaaaataggtgtgtagaatgtgaaagaagtattatcttaatcttatttttatagagatagttctatagatgagtttttttattgttgaggctatatttaaaatgtaattatgtaagaattgatatatacaaaaaatatgcataacatatacaatgtaaagcataatgcaaagaactcaccatccaacttaaatatcgtatattcccagtgggggaagctaccctgggctgcttcttgcccttgctttctctatagaggttaacactatccagaattttgtgtttacaaatcttttgctttataaatatgatttactacattttcatgtttctttaagtaaattgttaacacttgcctccttttgcttcatcacaatgtaattatattgtatgttgtcttctgcaattttcaaatatcaatatgattataagaatcagaaatatttttgcatgtggttgctagtagtagtctattatttggaaataccacaatttatttttccatttttctatcaatggacatttgggttctttcttgttttatgctactactatctgtgttgttaggaaaatataaataagggttaatatttttaaaaatatttacttgccattggtaggtccttctttgtgaaatacacaatctgtcatttatcaatatttttcataggatagtctgtctttttaaaactgattcatagattctggacaataatattttgatggtaggttatatgtattgaaaataccttcccttgacttgtagcacgtcttttcaccatctttatagtggcttttgtgatatagttaaatttaataatcagttcctttgtgatttactctatgtatcttgtttaagaaatctttcctttccgagataataaatatattgtatattttattccaaatctttctcatttattaaactgttgcagtttgtttttgtaaagaacccgattctccctctttttttcagtgtggagagctagttaccatcatagcacaatttattagaggttcacctgtttcccagttgtgtggtacaccgactatatatatttatgtttctgtccctgctgttctgttgcattaatctgatttgtctgaatcaatttaacgctatttaaattaatagttctgcaagtcctgatatctgaaaagctagtaggtcaagtcactatacattcttttttaggcacagcttgccttttttcttgggcctttactattccatacttattttagaattaacttgtccagttccttggaaaacactgttgagattttgactggaattgcacaaaatatgtgatcattttaagaagaactggtgtctttacattataatttcttctatacgtgtcttgcacatctttgttagttattgctacatatcttatttttattattattgtaaatggtatttctttttacatcgtatttttgaactgtgttttcataaagaaatgcaaatgatttttttgtatattgagctaacctacctttctaaactctattaattctgacaatttgtttccaaatgctcttaaattctctacatagcaattatataatttgtaaataatgacagtctgagttcttcctttctgcttcttatattctttatttcatttccttgtctttttacatgacccagaattattaatacagtgttaaatagaatcagtgatagtagacatccttgtcttgctctttttcctgattttaaacagaatatttttaatattctcccatccaaaataatgcatcttacaaggttctacattttaaaaaaaattttaagaaattttattttatttcttctttgcttttatttttacaatgtgggctttaaaaaatcacgggtgaatatttaattttatcaaatatacttaaaatgtaagtcttttttttcttttcattttgttaatatgaagaaatacatctacaggttttctaatactaagctactttgcacttcctgataaatttaacttggtcatttattagatttttaaaaacacttataaaaaaatcttgtctgtttattttcgcatataccaggtgagttttggcagcctcttgtttttttcttttttacgctttcttttttttaaaaaaatccttctatttctttaatgattaatacatggctattttgtgttttgtatctgataactatatgtaaagttctggggagtctaaaccaactgcttctaggctgactgcccatcagtagccttgttttcttgtatgcttgtgagtttctctttgattgagtttaatatttgaacatcctgaggacttaaattaaagatgctctttcagaggtgtttgccagaagtcagagcacaggactgacgtgggagcagtttaggatcttaagatctaggcttaatatgggagactctggttgaattaccttaccttgcagagagtctgaaactcgattgttgaatgcagcgccgaaattcatgctttccctcgagactactctggcgttcaactcacagctcttgtttcagcttctttttgaactccctgtgcccctcaacacacaccttggaaacttccttgatatttttgtgaggacaacaatgcgtgtaaaagggagtggctggtgactaataaggaatgatggctaactgttggaaattgattctgatgacactttcccaaaaggataaccaggaatattttgtgcaaaattaggattattataataggcatttagtttttcatcattacaaatttttgggaaaatcattaatcatttgaaaaaactaattgacacatctccgttgtagcaactcgtattttcacttctagtatcatgattatatcccctgtataatttggaaattgattttagcattaggaaagttcctagtttcagttaaaatgaattttttgtaagttgaattctattttaaatgcacaactttagtttgttatttctttccttgataagcatttattgaatgttgttatatgactaagactgtaagatgatcatgtttaatattttcacatttctttcatagtttccaaagtgtatatatacacttatatatttgatatgtatgaatctacttatgtactgtatatataaatataataacattgtatataaatgtatataaatatatatacatgtatagaaatatacaaatgtatatacatatatttatatacaaatatacaaatgtctataaatataaatacatttatatatacaaatataaatactgtgcatatatatatgcacacagtatatatttgtatatataaatgtgtatacacacacacacacacacacacacacagtattttttgatccatgcaacaatcttgggagatgggatattgttattatttgtacatttacagatgaggtcctgtggttcaccaatctttgtgttttattcaagattatgtaagcagtaaggggtgaaatcaggctgagaacccagatttcttcatccctaaacaaagtatttcttctaaaatttggtagccatttactagtttatctctatcaggttaccctttattcattatttttcgtgagaaggttgtagttgtacaaactggctgatatctgataatgttttaatctaattcaaagttgatttcttaaatccaggtgttagagtagcacactactgtacaactctctgtttcatgttttacacagtcaagttacaacttgcacatgttacattaaaatgtgagttcgccttcatttcttgaaatgagccagaggaagaagtgattttgtttttgtgatgagggaaatgctacttgactgccaaattggtctagaagagcacattaaaggtgcttgattttatactgttaaaattaaataaaccatggcaactgtcatgtcgtatgcaacttttgtattattctgtaagattttttaaaaataaaaagagatcaaactgatcttcaggtaaagatgcttttttctcttgtttatctcttagtgaatgattattagttccatttaatgggtagataatttattgttgctgttattgtttcaaaagtagctgaataaaatgcttaactttttcttcatagttaaaattaaaacctcaagtaagtaaatatttaacgttttgccaaattatgtaatctaattatgggcttaatgcatttaaggactctgtacagtttgctatgtattttcacacaagttgtctgaacataggtctagtcttcctgctgttttctgagtcacacagtgagtcagtgacggaacagctgtaggcagtggtgtgggtataatagggaaaagagagtgatggggaccacccaagtttagacaagctggtaaaagtagaagaaaatctttttgaaaacactagtgatctttaagggctgtggagaatgtttgcttggtgggtgaatgtgaaagaggcaacagcatgggaaggtgttggtaaaggagctccatagttgcttaaactgccttttgattgtgaggccgttgatgaatatttgggctttaggttttttatgatacaggatcttttccatttctggctttgtatctcagagatcacttagttacacttatagatgaacaggagttttaattctttgttttagaaagaagcttggcaattgttagtgagttacaaataagccaaatggaaaaaggtacatatttctggaatatcacgtaaagtttttcctcataaggatttagactcttgggtgtcatattaattctcagaagaatgggtataaaaagatatggaacttcttcccagggtgggttggaggtggtgaaatatctcatttattttagtttttatttttttttctgagatcatcatagacaagatcaagtaatggtaagcatgccaatgaattttctgaacactattcctttaagtgaaagaagagggtttcagcaaaactatttaatattggatcttctaaaagacagatttaagagtttcatctttaaaagtcagaaaaattaagttattttatacaatgaatattgccgtgccatgtgtaacagacgtgacatgagagggaatcagagaacatgcagttaatacaacccaaactagtatcattatttttgctcagtcacttccattgtctaagtaagataaataaatgacagcataaaataaaatttcaaaactactcaatcatattaagctattttaattacagtaaatgttttaatgccattaaatattcatcaccatccaaaattactgatgtaaatagtgttatatgttaaaggtaatttaacttccatggatgagaattcagctaatgtttcacttaacttttaggtaatttttttaatatcctggtattaaacgaagtccatgaatttgtggtggaagctgtgcagcggtacccagagaacgcagcattacagatctcagcgctcagctgtttggccctcctcagtaagtaacttcactaaaaaggagattcttccagaggcatttgacatcaaatatgaacattgtaacaagagaatcatatgtacagatgggagttctgtcctgtgtagctcattttctagtagagaatactttcaaggaaactaacagttatgacaagtatacacatctccatgtagagttttgctttacatcattcttgatttagctttgtcattaagcagctaatcttttttaaaagaatttttacttgtggccaggcatggtggctcacgcttgtaatctcagcactttgggaggccaaggcgggtagatcacaaggtcaggagttcgagaccagcctggccaacatggtgaaacctcgtctctactaaaaatataaaaattagccaggcgtggtggcgggcgcctgtaatcccagctactcgggaggctgaggcaggagaaccgcttgaaaccagagggtagaggttgcagtgagctgagatcgtgccactgcactccagcctgggcaacaagaatgaaactcagtctcaaaaaaaaaaaaaaatttttattttaaattctggtgtacacgtgcaggatgtgcagattttttacataggtaaacgtgtgccttggtggtttgctatacctattaacccatcacctaggtattaagcccagcatggtttagctatttttcctaatgctctccctcccccagtcccatcccccaatgggccccagtatgtattgttcctctccctgtgttcatgtgttctcattgttcagctcccacttataagtgagaacatgcggtgtttggttttctcttcatgtgttagtttatttgaggataatggtttccagctccatctgtgtccctgcaaaggacatgatatcattgctttctatggctgcatggtatttcatggtgtatatgtaccacattttctttatctagtctatgactgatgggcatttgggttgattccatgtctttgctattgtgaatagtgctgtgatgaactaatcttttcaaataatccttctctagtctattaggtttttttttttttttggtaccctcttcctgattttattatttatctgtataggatggtagtattatgaggtgtgtaatatatcaaaaattatctttataattgaccaaggcttctactaaagcacacctcattctgttggtaatatttcaaaatattgaattagagttggtcaaactgttaagtaaatcatatatataatgcttttatttattttttaatttttttcaagctgagaccattttcttaaatcaagatttagaggaaaagaatgagaatcaagagaatgatgatgagggggaagaagttaaattgttttggctggaagcctgttacaaagcgttaacgtggcatagaaagaacaagcacgtgcaggttggactctcataaatattagagttactcaaaattgtgttttctaatcatttatattttgacagatttcttttttctcccctaatccaggaggctgcatgctgggcactaaataatctccttatgtaccaaaacagtttacatgagaagattggagatgaagatggccagtcagtagttttgattttatatgatagaaaatttcagttatattttaaatcaatacctacaaaatactttaaccataacttttattgttagaaatatttttgatacagccttttagttttagatgttgctgccaaatagtagtatgtatgtagcattttgatcttattacctccaggagttagaaaaggtagcatgtttgagagttattattgagagatttggaatcaagaatcatttggtaattcacaaatcatggagaaagaatctgtttcctggctgttcgttttaaaatgccatattaattcatcttgggtgatagaaattgcagagccatctgtgatcttttcttctgtggtgactagccagcaggttgtcaatatcaggaattagatttggttagagagctccctatgatgagttcccatctgatgtgacagagttgacctgtcttcttttgagagggttatttgaagctgtcatctccagataactctttcactaggagtgccattcaaacatcataagactggcactctctcccaaagatacaaactgtagcaaggagttttgtgcatatcaggtttgtttcatatccgtgagcctttgtgttttatggcaactgattatgcttgtgctatttgcaatggatatcctctgggttttaaattgtgaatgacttattttggaaacaaatagtagtattctacatctgaaatcttgacagtctatttgtttaattatctattgctgataagaggggaattaataacacagatgctacttaattaaacattttcattttgacaagaaacagtagttcttttgaaaactatgctaaattggcatcttaataatctcatgttgagcaaggcttttggagattagggtaagggagattcatgttgcagtttataaattttagttcataggatacctgtttctcaatatccataagagaactttaaaataaatatattattaaaacaaagaaaataaatttatgttgtgcatctttaaaacttatcttgcttcttgacagtttttttattgttcttttctttttaccattatcttcttttcctcactttatgtttttcctcagcatctctttacatatctgctaagcttctttatttctctctgctgcttattggtttttgaaaaagcataaaaatactaatttattagtatttaattaatttgagtcttaaaaatgaactataattaactcttgtaaggggaggtggcataaaatattgtttacatgctcttaattgttgttagagatatttgataatggtaagtgagaatttgaggtaattatttaaaagattactactaacattttcgttgaatttttgaaagtttcccagctcatagggaagtgatgctgtccatgctgatgcattcatcatcaaaggaagttttccaggcatctgctaatgcattgtcaactcttttagaacaaaatggtaagcagtgtgccatattttcaaataaagggaaacacatttttgtggtagttttaattataaaagctatatattgtgagaaacttacataatttataaagctatatattgtgaaagatctctctgtgtgtagagatatattggcatgtggattatgaacatataggtacaaggatgaagaataaaataaacatttattgtatatttttctggacttctatgtgtaaactcacacatgacatatacaaaattttacatattttgtagaaatattatactctttcataaccaaattttattttcttttttatgttgatacatgtgtattctcacattatcattttttatttttaatttttaaaattaatttttgtttttagatatggtctcactctgtcacctaggctggagtgcagtggcatgatcatggctcactacaacctcaaacttttggactcaggtgatcctcccacctcagcctcttgagtagctgggactacaggtgtgcactgccatgcctggctaattttttgcagagatggtgttttgccatgttgcccaggctggtctcgaattcctgggctcaagcaatcgatctgccttggcctcccaagtgctgggattacaggcatgagccactgtgcccagcccaaattatcatttttaaaagctatgtagtttttcattgcatgcctgtattctattttatgaaccaatttcttattaatgaagtttcagtttgtgtctagtgggatgtttctgaaacccataatacataccaatgatcactttcctcctctgttttcctttatacatggttcctattattttcttgggaaaatttcatagaaatgcaactgggcagaaagctattcaccattttaaaatctggtaaaattgtctattataaattttcacactatactttttaaaaaaatggttctttacatataattcttataagtcttatagctttgtataattaagaagagaaaatggcttgtataccttcagaaagacatgagttttaagcttatggttcaggctgctcaaatttcttcccccgtaaacaggaatactgacagaaatccttaggtgaaaactcatcataaaggcattgggacttggcagcttttgtaggatatttttatagggcgaaaaatagagaaaagcactgaaagccagagacagagaccagtgtaagcaccagcttttaatagagaacctgggtagggtgggaaaaaaaaaataaagccaccacctcatgcatgtttctttatatcattattgaagctaaataaagaggaaaatcatttcttcttcctcttcctccttttccatctcacctctctgatggcactttaataaaacgcttggagtggcaagggcactgacagacagacaggggctgctctcaaggataatgagtccgagtaacaggggaaggagaggaaatcactgttctcgaatctctcatattctactgtgcagttaaagaggtctggacagggatttcactcccaaaaatgaggactggactttgtggcttctgttgaggcaccttagagtggaggtagacttttactatgtacagacaacattgtgttggtgacgtcattcataaccacctggaaatctcctttgatatgcaaattaaacaaccaaaactttgtgaaatttcgactgcttcctattatgatgtctgaggactggttacattcagagtacaccctgatgtcttcgttcagttctctgctctttctagttccctacttctttgttcctgaccacctgtcaggtaaaatgtcctcagatccttttgtattgtctttggagttctgccttaataaagcatgaagaacttgagtagctcattcatcacctttcttgggcaatttctcattgaaagacacttgagaacctttgggtgtacagagctgggcatggcttttttagaaaaatggctacactggcaggcagaagaactgggtccttggaaccatggaggtcccaaagttgcacacatcttgtgtgacattttccattcaattaattaactaatattcattgagctcccaagtgtctagtgtctgtaggcacttgggatacattcattaagtaaaaatcccaggctcatggaatttaaactgtagtagggaagataataagactaactaaaatatgtaatatttgaggcagttaagaataaaaaatgaagcaaggaaggagaatatgatacgttagaaatcagaggagatgaagttgtgaataggcagccaggaaagaaggtgtctattgagtaagacctgcagggcgttgcatattgttttttgcctcttaaagcagttaatttcctgttaaaatggagtggatgagatcaggagtattatgtagatagctggtagatgcgatagcatgtaaaatgttctataaagtctgacgtgactttatgatgaaatttcttctcctaggtttattgcttgcaattttcaagtcacacattgggttactgtctaggatagtgattcttaaagtgtggttcctggaccagcagcatttgctggggaaacttgataaacaatgtaaattcaagggccccatacagaccttctgaatcataaaccctggagttgagacccagcaatccatgttttaacaagctctctaggtgattctgttgcacgctacagtttgagaaccactgatctagtgttgtttttgtcttttaaagcgtcgtcttggctagaagctagccactttgggaaaggttgttacaacttctgatgtgatcgagcaaagtaaccaactgtttgttgtatattaacgtgtgctattctgaatgtgtttaaaagatacgagtttttcaggttctggcagtattgtagaatgtgtatgtgatttctgtttgtttccatgttttgtcctatcttcttgagatagactacttattttatttattttttatttatttattgttattttttttattattatactttaagttctggggtacatgtgcataatgtgcaggtttgtcacatatgtatacttgtgccatcttggcgtgctgcacccatcaactcgtcagcacccatcaactcgtcatttacatcaggtataactcccgatgcaatgcctcccccatccctcctcccccctccccatgataggccctggtgtatgatgttccccttcccgagtccaagtgatctcattgttcagttcccacctatgagtgagaacatgcggtgtttggttttctgttctcgcgatagtttgctgagaatgatgatttccagctgcatccatgtccctacaaaggacacaaactcatccttttttatggctgcatagtattccatggtgtatatgtgccacattttcttaatccagtctgtcactgatggacatttgggttgattccaagtctttgctattgtgaatagtgccgcaataaacatacgtgtgtatgtgtctttatagcagcatgatttataatcctttgggtatatacccagtaatgggatggctgggtcatatacttattttaaaagcagtacttaagttaaaactttttatgtttctttttctgccactttcaaagtgttgaatcacagtgtgtaatgttggaattgatacttttatagaggcttcaagacaattgatgtttatgtggaaacttgaagacaacagatttatgtttagtgaaggaagtttattgcaaagaggaaaattggcctgttgtgatggctcatgcctgtaatcccagcactttgggaggccaaggcaggaggattgcctgagctcaggagttcaagaccaggctgggcaacatagtgagatcccctctctacaaaatattaacaaaaattagccaggcatggtggcacacttgtagttcctgctacttggaagctgagataggaggatcacttgaggccaggaagttaaggctgcagtaagctatgatcttgctactgcaccccagccttggcaacagcgagagatgctgttacaaaaagcaacaacagcaaaaaaagaggaaaattattccttaatcattattgctggaatatagttnnnnnnnnnnnnnnnnnnnnataccagttgtaaagcatatctctatgtttcctagagtttggcattactttgtgaaaataaccataattacttatattcttatattaaatgcttatattaaatgctttccattcctttgtatatgatggactatattctaaatcttatggtaaaattatgaaaatatgctttcatatccataagtgacactttaaaaaatctcagttaatttcagaaaaatcctgttatcaaaaggaatatacctgaatgttttggagttaatgcagaagcatatacattctcctgaagtggctgaaagtggctgtaaaatgctaaatcatctttttgaaggaaggtaatatagattcattaacttgtacagaatatatcatattgggccaggtagaatatcaatatttcaagcatatttctaacaatgaaaagaaaaagaaaaacgtaagacacttgaaaattgaagcattttgcaatgtaatctcgtgtcactagtaccatagacttactttatctgaacactgaaaggaatggcaagattgtggaaacatgttgaaggtctggttttgaacctgatgcttgatgttgactgtattttgaaaagtggtaattgtatagcacatagcatacagcagtttttctaatattgtgtgtgtgaaagttataaaagataaaatcaggatatagcttcctaattgttgttctttcacaacgaatatattattccttcatttgaatgaactttggcttctcttcctgctctcaatctttagttagggaaaattttaactacatctagtccaagtgcagagatgttaagattatacagctgctggttagtggcacaacagagaccagatcctttgatctatgtatggatggtggtgggatagagtgggatgaggtgggggtgaggggtggtaggtgtgggcagaacttgtggcttaaaaaaaaaaaaacctgtttaaaagacgaaaaatgaataatatgcagaaggtacctactgtagaataggctcagtgcctttttgcattttgttaagccaaaaaatatgatgtaaatttggcattgtctgagtaaatttcaaacaaaaagaggctatatagaaaactctcatgtgtagacaaaataattggcacagaagttgcagtaaaaactaattttgttcctggctttgccactaatttgagccaactgtttcatctctaaaacttcatgttcctcattggtaaagaagaatgttaataacaactttgaaagttgtaagcttagaatgtaaggattaaataaattaatttttacaaagggattaggataatgcctgctacattttaagcactcaacaaattatatctattgttatactgttattaagtgtgaatagatgaagtgcatgtagcatgaaatgtaacataactgcagacttgtaagaagtagggttacactgtttttaacatcagtctagctaatctatgtttatatatctctttaagttgtatttctcttatttaaatgttgtttttgaacactgagatgaaaagtttatcttaaatgttgattttaatggcgccgaaagtgtgcaaacctttataaatgaggcacaaaaacagtggaataaactccagtctaggattctgtagattctgggcaagcgatttgatgtttctggctgcatgctcttaagtaaaatgtgtacagttgcagtcctggagattccacattggctctggcaatgtgtctgcccctagagaactcatgttagttgagagactgatatgtaaacaggttattataatacagtctcagaatgcagtaacagtagtgtgtaaaatacacaatggtaagagtagagtggacccagctggggttacctaaggagggcaggctccaacagagggatgtgtttaaactgggactttaagttggaaaagaaggagtgtatctcagtgtccacagaaccatgcaaagtgagaacatggttctgatatgcacaagtttcagttagcaagtaaagcaaggattgactgtattaaagttcatagtacctaccgcattctagtcaagtgacatttgctcatatgtaaaagaaagaatagcttaaataccttagagaaaacaagactgtaaaacaaattaaaagtaattaaggatactatataagaagtccagtgatgttaatctggaagaggaaggttcatgtgctgtaaagaggccttatcttggggtcagacaagtttgggtaccagccttgtctctgtcactttctagtgacaaaacctgaatatttaacctctatctgcctaagttcttcatgtagaaaatggggataataacacctacctcctgggattgttgtcattgacccaccctaggtcagaaggatgttgttagttttatgaaatgaaataattcccaggttactatgaattctatcttatgagttcaaagtttagacaattaaaattatgtatgcttatactgctgatttcaaatgcattttcatatagtctttcctgataaaatatattggttctgtcctcctgtacttacttcaatttggtgtttataccattgaatcagatcggtcttccaataaacatgccaattttatatccccagcaacacttccctggatacaatggcagcagtgctccccaaaataataacagttatgaaaagtcatgagacatcattaccagtgcagctggaggcgcttcgagctattttacattttatagtgccaggtaagttacatagttgattgtgagaagagataacaatttaaagggatttttgacttttcatgaaatagcaattttctaggcaaatattaaaagactagtttctgttgactaaatgtaaatctttctgttacaccaaaaacaaaaataggggttaaatatgatgcagaattggcatttagattaatttttataaaaaatatgaaattcagtaatttatttattttaaataactacaatgtaagatgtggagattttatttttaaggagagtgttcatctctgataattgttttctatttttgttgctgtgacctgagttcaagctttttttcacttgtttgaattgtactattagctaattttcatacctattctcttccttcatttccatccttttcttactctgtgattgaattaatctttctccaatatggcgtgtactcatttacctcaatggcttccaccctccacccacctttaattcctacttacatctgttatcaccttatttgttctcaaaagcccctttaaaatacccatgtctctattcattcagcacatttattaggtgcttcttatggtctaagcactgtgatgctgttaagctttgaaagatgaattggaaaaaaagcacaactgtactattataggagcttagaggtagatggacgtgtaaatagttaattaacaggcagtgtgagaggggccatgatagatgcatgtataaaaggctttgagaatattgattgaggcacaaataatttcttcagaggagtaggacagagattataatatttgaggtggaagggtaaatagagctggcctggcagaaagacgaaggaggacatttcaagcacaagaacatgcacatggtcaggggtgagtgaggcatagaggatgaggagagtagtgcatggggatgagtgtggaaggacaggctgaggcccaaagaaaaggggcttgaatgcagtgttgaaaaatctatgccttgtaacaatggaagttaatccaagtttatgaaaagtgtttacagattgtagtgtcacaccgaattttgcaactaaagacaatagcattgtggtgtagaggatgatagacagggagagagactatataaaaggagattgggttggaggtctgtggtagtcaagtgagacccggtgaaggaaccctgcagtggaaacacagatgagagggcagattggacagatggttgggagatctgtttgatgtgacatcgtgatccctaagtatgagggatgatgctttgttctgtgaagttcccaatcttttgcagtcatttttgctttgttcttttaaaatgaaatcttcctaaatctatcattttctctagttatatagacattttatgtttctgcgtataagagtattattcgatatacaagttttttaaggacagagctttcttcagtcatgtttttccagtcctctggtagctattcagtgttttaaaaattgagtcatggtgtcctattcatagtttcagcttaattttgagacataatttaacagatgtaattttgcttgcaaatattattgcgggttttattgaattttatttttagattgtaattaaaaacaataaaaatgccttttgattatccttaaagttgacagccttattcttttgagagaggttttgagttttaaagataaccagaggacactcaaaaaccgtatctgttaatgaaataatattcttttagtccaaaagtaagtttggaatacagtgtttcttttcttttattgttcttaaactgaccctgaagcaaaattgttagtcagcaatcaatcagatgtattatgggtgcccttgaaaataatcacttgaggactgtacttcatgtaaaaaaatacattttataaacatatcagtatgtaagtacattcttctggtaggtaaaggcttaatcatttactctatgctaacatattatactaccacattacaccatactgtattgtaccctaccatcatgtaccatgccgtgcagtaccatatcattctaggtatcaacaaggaactatggtagcaatactccggtagtttctaggttgaatatgattctgttttgaacatgctaagttgaggttcttataagatacctaggtgtacatgtattcatttattaactagattatattcaggttttttagtggcaaagatgtacgttatggcaaatgtgtataatttagtgtccaattaaggatagcatattgcatctagtgtatgtatcttaagtttcttccaatttattactgtacattttctcttttactttgtaacaacttgttgaagacgttgaactggttgctttaagaaaataataataaagacccagttacttcaataaaatatcatttgacttgttgtttcttgagttactgctagttttagaggaaataatgtgaagttctttaagaagggatataggcgaatagggaagtatacagaggagagtgattagggagataaaagcacatcaaaaagagcgataaaaggaactgagattgttttatttgaagaagagatgactcaaggggatatgaaactctgttaaaatctactcacttacaaccagtaacagtaataatactaaacgaacatggagaacttaaaaagtattagtcattgtttgaagtgttttaagtatattaactctttcaattctcacaatactccatgaggcagatattattattattattattattttggtattgtatggacaacaaaactgaggcatagaattgtagaggtttttaaggtcaggcctgatataacagcaccagattttcagcgtatgcaggctgactccagagtaggcattttaaaataaatgtttgtgcaacaaatttgtcctgaacaactgttgtatttaaagcactatgtctagaatccttaaggtctggggagatgatgaggttatggacactgctctcaaaaaaatgtaccatctgcacaacttaaaggactgttatgtagaaaggagattatatccatttgaatagtaggacctcaagtgatagaacaaagactggagaagaaatttacaggaatgttcatttggtcttaatataaggaagatgtttagtaagacccattacatgtagcatgatgtttttactactcaaacaggccagttttagtgatcacattttcttaaggcataataggcagcctcagaagttagtgtggtcttggtcactggaaatgatacacagagagtttaagggacttgccccagaccacacgactgcagtgaatgtcagaacctctttgaatacattttaaaataaggactgaaagttggagtagggtggttatcaaggctgccttctttaccatagtattcccagcatttaacaaaatccttggcatgtaattggaattcaaattcttcttaaataaatgaaaaacctgctgtagccagcttatagtttgtattaatgtagattattaaagtggaagattttaaatgattgtttgttaacaattatgtctataatcttaggtttggaaaacattattcattcataatatttttacttacatgttatattacatttttgacttgtagtgtttttagcatagttcaactatagtgtagcttaataaggaatatgattttttaaaaataacaatgctattctatagcctttacaggacttctaaaaaacgacatgttctctaccactttaatactgaaactcaaatcttattttttgccacgattattccagctactcttttttgactacttttcatttctgacctttttatgttgtagtccaaataactttgaacttttctcaagttgtccattgttgcatacaaatcttccagcatcttaaagcacagcctactcacacaaaaaagtgattgcttgccgcagaaaattgcttcaccatcataattttttgctacttcaaattcagtaagcattcttacacattatatttattttatattcagtgatgaactatctttatagattccttaaaatttcgggttatttctttgataaggaaatatgtagtagaaaaaagtacaacacatatattgtaagattaattatgacaatttctagaaagtaacagtctgttcaactcaaatgtttataagaaaagtctttctttatttatttatctgtgcatttaggcatgccagaagaatccagagaggatgcagaatctcatcgtaagctaaatatggttaaaaaacagtgtttcaagaatgatattcacaaactggtcctagcagctttgaacagggtatgttgaatatgagttttctgtctttacactgttaactaaagtattaaatttggagaactagggggctttttcagtcgaagttttctattctccatttactatgatagcaggaagtcatgtggttagagacataagatgtgggaagtgaaaagatacgtactaagctaagtccagctaagtgtattatcaattgcaaatgtaggcaagattcttttgattgccagtaatataaatccactctagtttgctcaaccaaaaagagaaccaaagagccagatatgcagctagaccttatgagtcatgctgggtgctatggctgctgttttctctgtctgtcctctccggctacttatctttcttttctggtctcatggtatatgatttagcccatgaagacataccagggttaaaagtaaagtcttcgctgggcacggtggctcaggtctgtaatgctagcactatggcgaggctgaggcgggtggatcacgaggtcaggagttcgagacctacctggccaacatggtgaaaccctgtctctactaaaaatacagaaattaactgggcatggtgatgcacgcctgtaatcccagctactcgggaggctgaagcaggagaatcgcttgaacccaggaggcagaggttgctgtgagctgagatggtgccactgcactccagcttgggcgacagagtgagactttgtctcaaaaccaaaacaaaaacagaaacaaaaacaaacaaacaaaaacagtaaagtcttctttgattccctgtgctccttttcattgctctcctaagagataacctctgaaatgatttggtatacattgtttccatttattagcatttatatatctatgttcctacgttataattaaagtatcaataaatcatactgaatatgaaaaagagaaaaagggaattaaatttaaattgtgtaatgcaaaaagttttggtggaattaagttttggaaattttgcataaaatgcattggttctttattaaagatgttaagaataaagacatgattagtgtgaacgtttttataaaaggaggagccaatttaaagtaattaatggaaatgattccatgtgtttgatatactttgataaatgtcataaattaattaaagtagcttccaaagagatctcccttaaaaattcattttaaagtgaactttataatgtcactcactgcctataatatgtttgagtcatttatactcaaactttaatacagtccttgagtatggcaagaatttatgttgtaatgggttaaatttaacttgagaaatatttgttgaaaataagtatatggaaggaagcggttaggcatttagaagataaataaaaatgctttgtacccttctctcctgaatctcataatctggttattgatgtctgttgtgaaaccttggttcttttctgtaaacaagagacacacagcagaggagatgcagcatcgagtaatttattgcaaaagaaagaatattttgcaggttaagtgaggaatagacacttaccctgacagaattcagggcgggcttgctagtaaggaggagactgcatagactggcactaggaagactccatttgtgggagtcatacatgacttttcataagcaggtgggaagacgtgttactagtaagcatattctaggttgtcctctgggtgcacatgtgcagtagctgtacatgtttgttcatatatcccatgtctcataactctctgaaatctccacccagcggtgtgtgttttactattataatgagcaaagggtcagtctgaggacaggaaaatcaaaatgtgcatgctccctacaggggcaattccctactggagatagctttgcttgaatgagctggactacaatgcgaatgctgaaacttattatgttgacagtaagattgccacagttgccgcgtcctgaagacatggttacttccttttaatacctatcctgcctcattgttagaggaataacaactgtgcataaaatcagttgttctacacgagcacttaggagggataccagcattgtgaacatagtctaagtacatagaggagggaacagttaattttattcatggtgagtgttggtgaaaagtggaagaggtaccaaaaaagccatatatataactggttccagttagccaatattctctaaagttattagagaagcctaagtgagatgtaacctcagcagtcgggagccaagagagcaggtaagtgctgtgatgtggagaaaatcgctttgttccatctgagaagaaatggttgaacactgcttttccccccacgccagtacttcagtaatgacgcacagcctttcactcagcactgattatcgttagaggtggcgagttaaggtcatggagaaacacaagtaacaatattttatttcaaagacctctccagtgtaattcccctaatccttcaccatggttgagaaaaatggctctaagagatgagagtgattactgtagctccaaaattctgtgattgcatgtcttactctgaatagtaattacaaagcatcagaggttttaggtccaaatattgcagacacgataaaatgaattacattttaatacatctaaacttggagagcagagttccaaataaggtagaacttgagattcaactctgatttataaagcagactaagaagagtatttatgaaagtgaatccatgtttggatacataaaaatgcaataaaattcaagctgaagttaaaatctctgtctagaacagcgatgttccatttatgcctgatccttttagcttttccacagatgaagactttgtcacctgttccagagagatatatttgtccattattgtttccagagagcaaagcagaaaatagactctacacattttggctgcatctgtgttttatatgtggtgacattcctgtgttcttcagtgaggaaatccagtaaagtaaaacaaatcttcagatgaaatgggcacaaatcagagaacttgtgagcttcacaaaaaccttgaagcaaaatatactcagcttaaatattgaatatatttatttcagtagtcaaaaaaagagcttatctgcaaaagcaacaccaataacaataacaacaaattgcatataagtaaaatttataaaaggtttacaggatggatatacagaaaactacgaagcttaggggtagagaggagtagctgaatgtatgagaagatacatcttctattttgataaaaggactaaatttttaaaaatgaaaattgatctatgtttatggacccttagtaaaaataacaatagtattttctggaactaagtaagctagtgtaaaatttgcatgaaaaaattaatacatatgagcaatcaggagaattttaaacaagagtgttaattcatatggcctaactccaaaagataatcaaatgtattatacaattttagtaactataatggtgtgatactggcactagaggagacagatcagtgccacataagggtggctcaggaaatagacttaaataaaaatttgtaatgttatgatattcctcgactgctgggaggaaaatagattactcagttacttgtgttggaacaactaactcttcagccatttgggaaaagcaaaggaagctgaatatcttactccttttgccaaaacaaattacagatggatgagattatggtctaaatgaagttggtatatgtacacattaaaagtttcaactataattgttattaacgtaaatgataacgaaatagcttgttggagagaaatttggtaatatttatcaaaattaaaatgccatattttctgatcagcaatttcattctaagaatttttaatgtagatatacttgctcatgtacagaaatattattagacatgaatgttcactgtggcatgatttgtaattaaaaatgtggcaacaaactaaaagcttacatgataatcattcatgctgttcgccaaatatttttagttctccaccttccggtgattctggcataggatttagtagttaggttgaagcatgtgactaagtttggtcagggagttgtaaatggagggagcactgtctcaggtatgttgacctgcagtgtttaagatagtagttgctctgtcagtggaggtccctgagggactacaacaagcagagtcccctcctgacctgcaacacatatgtagcatgagcaataatggagcttattatttttgcaccccataaaattttgagaattgttactgcagcttaatttaatctttcctgacaatgcagtactcatcaatagagactaatcagataaattataccatttccaaattatatcatcctacataaatattaaaaaacaatgaggtgagattcctaatgtgctgctttggaaaaatcttcaattttctatgtgtatgaatgtattccccaggtattcgttttttccttcctgtgtgttgacaccttatgcacacttttggctgaaattaatatatttccactgctttatgtcctctccctcgcttttatcacccaattgtagcaaattatatgttcgcttttatagctttagctatgtaaaattttctaatagctaagtttgtggtttctggaattaagacatctgaatttaagtctgacaccactacctacagactctgcaccctggacaagtacttaatgtcttggttttattatgtataaaatggagataataactgatttttcagttagagttgttgaagattttataagataattcatgcggaagtgtcagtataatgattggcacatagtacgcactcaataaatgttaatgttattgctattagatttaaaagtatgttttgactcctggctatataagatgagagtatttgcacttctgatatctcctgttttcccacctactttttttcaataaactaactccacattggcagagtagataatatttatattcagctttctaattatgctttctaagtttgtgtttaccttattcctacagttatttggaagcagtcttcatctcaagtccttttgttattgtttttccattcatcttttagttgtctgaatttctttagaaaagtttaattccttgaatatctaatgtttatatttcattgttgctgtttttgcctttataaattttgcactcttaaaaaaagttatgttggttgtaaaatattgttttttttttttttccctgaagtgtttgtaggcatttcactgtgttctagtactgaatgttttagtggagaagtctgagaccagcttcatttgtttcttactgttaagtgcttggattctttgcctggcgctgaaagaattttttctcttgaaatctatccactttagtaggatatatctcaatgttagtcctgggatatggtattctcattctagctatacattcaactttttttcctgggaagttttattgaattgcatctttatatacatgtatattacatatacatatacatatacatggtaaagatattaaggataaagatagatgctttataaatatcaattcgatataattttggcgtgaaaataagcctgtggtgcattttgagtttggaagtagaactggatatacttacttattattatttttaatacaaaagtggagacagggtctcactatgttgcccaggctggtctcaaactccttgactcaagcaatcctgcctcgacctcccaaagtgctgagattacaagtgtgagccaccgtgaccagcctaaatatctgtatttttctctttcattattttagctctcttctttgaggctatcagtcatatgatgttggatctcttttgccttaatcttttaatttttcaaagactaatccagcgacactatcaccatgccacttacttgtagacaagggagatgattccaaacatttagcttatttatcaaaatcagagatgggatttataagaaaaaaaggataaagggagaaaacaaaacacaaattatctgggaacgtgagtctgttttcctttctttggctaatctacttacctagtagctaggaaagaggccagcgtgagtatttttccattgagctggcaagctcactcattagagaaaccatttcaatatttatggattctctgaaaaaaacttggagagtagtaaagcataggtggtaggatgctgccatccttctgttggcatctccagagtttcacttgaaaaacacctcctaagtagacactagtaaattgattttaatccctatttgagcaccagtgcaatacgttactattgcaagatggagcattagataactgaaggaaattcttttgtgggtttgtaaatatcacgatagtcatacctacataatacatatatgtatatataaatattaatttttaaacatttacttagctattaaaaatcaaatgctcatatttaaaattatgagtttatactctgaattctctttttgcatagacaaatcagagattatctgttacaagtcattagtcatcattgacctggactgaaatggttagagcctaggggagttccaggtaaaaggaccagtaaatgagtagaaactcgttagatgtagagctattaaggacaaagggaggtgctttataaatatcaatttgatataattttaacataaaaagaagcttatgatgcactttgagcttgggagcagaagtggatatgtaattgtgtaataaaatggaaatgcactctccttgtttgaaaattattaaggattttacaagggtgatgacagagcattgaagcaagtgctctctgagcatgaagccgtatatgattgtacaaatacacacctgtgaagctggccttgcctgtcaaacaggaatgttggtcctattaatcgaacagaaagttcagaatgacaatctgactttgttttgtagaagatactaagttttggccttgaatatttgagttaagatactggtatcaagcaaaaataaatttgggcttagaactttagagagtttaaacttgtgctttgacttgtgtgctcacatgtctctgtgtcacaatttttttcatccgtacatcaggacaacaatagtgtgtctacatcacaaaggttttgggaggattaagaaggtgaatacatatgaagtacttaaaagaatgtctggcacagagcgagtgctacataggttttggcattgttattgtggtcattgctattgttattacgacctgaagtcatcttagtgtatgaaatcccacatatgaatagaaaatagaaagaactttgggcaaggtttggaggtgaaagaagagatcgtaaagaagatgggtaaaggaatggttttaaagattgagaataattaggggggtactgtgtcatggaaattaaggggtgaaaagcaccaattaagttgttattagacttttttctttggtttatgttcagaatggctaggaaagaagtctgattataggaaattaaagggtaaggcgaatgtggaggtagtgggagtcgacttttctattgataagtttagaaataaagaaaaagtggtaacttgaggaaagagaggaccaattaagggaaagtctctcattaactctgaagtttttcatctctgaggacagcgcttagccccaggcctgacctgtgatgattgctctctccaggtctgttccatggacagagccatctcatctcctccccatcacagcctgcattaggagaattgttttaaggatgagggagctgagacacagcaaaccagccttccaatttcacttcgcacgactctgaatttctttatatttcttgaatagaagtttcactttttacttaccacttcttagtagtcattgtctgagtaattgttacttcattcatttaatggttctcagatttatttaatggttctcagattcacagaatttaaacccaaatttaattggcctccaagctgatgtgcttatggaaacagtgacaggaaacaaaaacgtcacgggagacaatgtcttattaagatgatacatgaaatgatgtccaagctgagcaattaaagtgtgaagtggaaggacacagggtgagaaactgatacttctcagcctctgtaaagaagataatgagtaaagataattgagaggcattaggggagtagactgagaaagggatagaaatctgttcactgagagtacagaaatgaggaagcttggaaggcagaagatttcggtcaaagacatccggcttgaagctatttcagctctttggattatctgtggtggaggccatcacgtctttggagtggaggtaccatgaaacgagtgtctgcaaaacatcatctaaatgaaagcaaaattcctgggaaggatggcattataatttttgaaagaaaagctatgagttgagcattcacaccaaggtagatgtttggagcgtattgcttgtgtgtgaaaaggcagagatgaccagaataagagttagatgtatgttgcattttcttcttggttgatgagtaggatggtctggacaaagaagtgacctgtattaaaatacctttataatgtcaaagcatctggaggaaattcagattaaagaggttggatgatgttgtaattaagatcctgggcttttaaggtggaaacatttatattcaagtcccaggcccagtgcgtattagttctgtgacttgagctcttacttctgcatcttcaaagtttggcaaacctattacatgaagctgtcgaggagataaatgaaataaggcatgcaaagaacttgcagtgaagagtaattatcaatattttctttgttgagaggcagcattgcgttttactggtcattacattttactaactattaagttagtgtggactttgagaatagttctcaaccattctaaccctcagtgaattcttcttctaatgggaatgatatcagtatggatttcatgagattatgaaaagaaaatgcctacaaagtatttattacaatgcctggcacagagcaagctctcattaattgtaaaaatgctaactcttattcttcataatgcataaacataattaatattatagaaaacaaaatcaaggatactaatttgtgtttggattaattgatttatatttcatcagtctataactggtcttaactaaggtaagtattaagatctcatttttaagagcaagtattcttttgatttcagttcattggaaatcctgggattcagaaatgtggattaaaagtaatttcttttattgcacattttactgatgcattaggggtgttatccctggaaggtgctgtggattcagtgcttcacacactgcagatgtatccagatgaccaaggtcagtacaatttgaattctggatttagaatagatttttgtaggccattagctggcgactggatgtctgtaaatatttttcttcagttttgagatttaaaacaattcttttttttttttcttctagaaattcagtgtctgggtttaagtcttataggatgcttgattacaaagaagaatttatgcataggaactggacatctgctggcaaaaattctggcttccagcttataccgatttaaggatgttgctgaagtacagactgaagtatgtgcattatcttggaaagaacttgggaacttgtgcaaatttcacttttggagcagttcgtgtaattcccactttgcatgaatggggtattctagttaatggaaaaccatttatcattttgtagttattttaattatacaagcaaagaaaattggattgaatctctaaagatccagtgtttcattattaaatctctaaagtcagcatgtttattcaccatttatcttgcccataaaagttcagagactgtgcttagaaatctcagctagagctgaatttattcacttagattttagataaatagaatttataaatattccaaagtttgtcactctctggttttattgtaggttgcttacctctaataatttgacttgttaatttttttccttgcagtgaaaaaaatgtttttaacatttttcatcaagcaaaatttaaaacatgatatataataactatctttataaggaattcaagatattggcctagagtgagttcaggggagattaagaaataattttttttttaattgtagcaaaacaaatagcttttcttcaagagtttctgtcttagttgtggagtttgcaactttcataaactacactaaggaatttttttttttttttttttttttttggagacaggatctcactctgtcacccaggctggagtgcagtggcagatttcagctcactacaacctctgcctcctgagctcaagtgattcttgtgcttcagcctcctgagtagcttggactacaggcatgcactcccattcctggctaacttttgtattttttgtagagatggggtttcaccatatttcccaggctggtctcaaactccccagtctcaagcaatctgtcctgctcagcctcccaaagtgctgggattataggtgtgagccaaggtgcctagccgactcaggaaatattttttgtaactggcagcattgaccaggaataaaaatacttggtctctaatctttgcacagacaccatcagtaaatgagagaatgtgtataaagtgttttaaaaaattatgaagttaagaacatacaaaattcttacattaataacaacaatgtgttttataactgcttttcataatgtgcctcaggataggctgattagagcaagataggattgattaaaagtaatcttaaggaaaggaaaggattttatgcgggtatggaactctcagtcactctggattaattcatctaggcattaattttagaatctctacagtagaggttatgaactaaatctgtcctgccaacatattttatttgtccagttcagtgttttattttattttttgagacagggtctcactctgttgcccaggctgtagtgcagtggtacaatctcagtgcacagcgccatccgcctcctgggttcaagcaattctcctgcctcagcctctctagtagctaggactacaagtatgcaccaacatgctcggctgatgcttgtatttttagctgagaggggttttgccgtgctgaccaggctggtctcaaactcctgacctcaagtggttcgcccacctcggcctcccaaagtgttgggattacaggcatgagccactgcacccagccttcagttcagtgtttaaaagtttttaattcgattgatgtactttctgcacatttgcatgacctgctctgctgcagcattcactagttttcagggacctctggctctagaggcaggtagaccacctgtccctcagacatacataaattaaggctactttgcttatcaaatattagtatttgtagaaactcagtatcataagagtttgaagtaataattttaatatttagatgatttaacttaatttaaattttttttgagatggggtctctgtggcccaggctagagtgcagtggcacaatctcggttcactgcaacctctgcctcctgggcccaccctcctgggtgggctcaagtgatccatctcattctcctgagtagctgggactacaggtgcacgcacggctaatttttaaatatttttcatagagacaagattttgccatgttgtgcaggctggtctcaaattcctgggctcaagcaatcccagagcgctgggattataggtgttagccacggtgcctggccaattttattaatatgtaattttagaggtaataaaatgttaaaaagttaagatgatctttgggtttacccaagctaaataatactaaagtcaaatcccagtctttcattaaaacatcacatgggtgaagaggacagactctggggatgtgcttaaggtggttctaaaaaagtaatggtgttctttataaataacttattattataatgtaatcctcagagtgccctcagtgcttctctattacactcaacataaatgaaacctaagagtccacgctagcctttttgaggtaaacatttcagaagacagcacagaaagttgggggatatgctaggctctctagagaacctactattcatattataataaaaatttttactctgttttcctatttggatgtgtagctctgctgatccaactgttttaatgctgtttaatatctgggtttcatcctacaactatggctttagacaagcatctttgaaaaccaaatttgaggggattagttcttttttctgctttgctactggatggttaactagcattttattctttgtacctgctatatttcttagtcatgagagagagagggagtatttatttacaggataaatactttcaagcaccaacccagtatatctatagttaaatgaacatcctaggtattgtttcatatacaaactctctgctttatactgtttattctttttgcctataattgcttagtttattatttttttcttatacttttagggatttcagacaatcttagcaatcctcaaattgtcagcatctttttctaagctgctggtgcatcattcgtttgacttagtaatattccatcaaatgtcttccagtatcatggaacaaaaggatcaacaggtacagtgttttccacttgcatcctaaatgttatgtatttatctgactctaattctcatttccactctttttagtttctaaacctctgttgcaagtgttttgcaaaagtagctatggatgatgacttaaaaaatatgatgctagagagagcgtgtgatcagaataacagcatcatggttgaatgcttgcttctattaggagcagatgccaatcaagcaaaggagggaacttctttaatttgtcaggtaaatattaaaggcctcacttgtgtctttgctcattattcttatcaaatgtaagagccctgccgctgtgtatctcttacttacatcatattattcttcactacggaaatttaccagtttattgtaattgcttgtatcttgtagtagggatttagatttatagaattccagaagtaatagggtcctttaggtgttatccagtctaatctttcatttcatctgttggcttatcttgttaagttgataaataacttttcaaatgtgtcccttagtaggcatctctacaacttgttctccagatacactccacataacacatagttctaatattttgataattttttaaccatttttttccatggttttagtttctttgcctacaaagttctcctctgagggctaccacacatgactatgcaggctgtgaatgtcacacttttgtgggtgccattcacactgacatgagttgctattggccaaagttgtgtagtagtgtggtctttctttccttctctcttccctcctgaaccatgcaaacatatatctgtctgattgttttgctcttccttcaaaatataattcaaattgcctttctttaataaagccctccccatacctccaaacaaaattaagatttacttcttctgtcagttcatgaaaatatatacatatctcttgtgtacttggtgagttgtgtgaaaataaccatgtatagtgttcgtctttgtatgattcagaatatctagctcattgctttacatatagtgtatattctaataaatactaagttcattgcttgtatttcagatttgtattatttgtataagtgttagagtttatactagcattcaggtagcactatgtctattttctagaaatttaacatttctaacaaatattaaatttcagtatttaataatcagtattattatcagtaaataatcagtaaagtactacgtttgccaataatttactttttaagctttactgtatttaatatcccacttgcctatgaattgaagttaatttgttgactgttaagattaagttaatactaattagtaatcaacataaaaagaaacagaacgtggaacccattttcatgcaccattatgtttatgcattaaaatcacataaacaatctaattatttaaatttagtcaaatttcttttaagcaagcaaaaattaaaatagtagttctactttattaaagataattaaatttttccatcaataatttaatacatttttatggtgcatcttttgcatgcagattattgcattaatgttaattgaaaataccaaagaactaaaaagaaacttccccttctaagtccacattaaggaaacaacatacctaaaagctcctgatacaactttactgcattccccacaggaaatcatttctgctcttctttccatttatccaaatcttcctatacaacaggatttttactttatttctctttccatattcttttggccttcatatgcttatttttatcttttcttttcaaaacaaaatcttaaatccaaggattatgtatcagacttaaagaatttatcccagttgtcagaagttatttatacctagcaaataataactgctgattaaatcttgtggatgaatttattgtatgtaccttatttgtgccagagcaaaataaggtaatgaagactattcatttaacaagaggttgcatgtagaaggagtatctagtgcacgggtggagttgtgttaggctttctgcagaaaatttaataatggaatgtacatgactggtggagaataatatgaaaggttaatactggatatgcaaatgcatggataaaaacctcaaggtaaaactcatcaaatcacagtggaaaaagtatagtgaagtctgaatgaaaataataagaggctgggcatggtggctcacatctgtaatcccaacactttgggatgttgaggtgggaggatcacttgagccaggagttagagaccagcttgggaaacatagtgagactccatttctacaaaacaaaacaacaagcaaaaacccatgtatgatggcacacacatgtagtcctagcttcaggcagagtggctcatgcctgtaatcccagtgctttgggaagtcaaggtgggaggatcatttgagcccaggagtttaagaccagcctgggcaacatagttacactcccatgtctacaaaaagtcaaaaaattatctgggtatggtggtacctgcctattgtcccagctacttgggagtctgaggtgggaggatgacttgagcctgggaggttgaggttacagttagctgagattgcaccactgcactccagcctaggcaacagagtcagaccctgtctcaacataacataacgtaatataacataacataacataacataacataacataacatagcataacataagaatgctgaggcgggaggatcacttgagcctaggaggtcaaggctgcagtgagctatgattgcactgcggtactccaaccttgatgacaaaagcaaccaactaaccaacaaacaaaaaaacaataaaaccaaacacctccatcatatgcattaccagctaggcactgctccaaatactttacacaatttaatcctaacgacaacctatgaataggtccagtagattctaatgttattcccattgtacaagtgagaagttgaggcactgagggattaaataacttgcctaagaacaagctcctggtaaatagtgcaaaatctgcctccacagtgcctgctttgatttcttggctacacagcagattcatggtagtggtggtagtggtgttcatttactctaaaataacagtttaaataatttgattttgataatgtgctgcatttattataaattagatgatcagagaaagattgcagggataagaaattatgcttttgataatctttagttattatattctgaattttcttcattatttaaatgtgaaaataaatatctgtaagcagtagtattttcctgtcatgaagttgaaattactttcataaatatgtgtgaatattctaaagagaatgactctgtaggatttaaagaaattaattcttatttttgctgacatttatttcttttctcagattccctttcttatatctctctctcttcatggcacccatatgcctaaagtcagcttggatagtttggatcctccaaggaaaattccttccacaaacatgtgcagagcacagtgctagataattaatagagaatatataaggggtttcctgtttcaagaagtttataggtctgtatgtgttgggacattgacaagagaataaaacataaatcaccttagtacaaagtaaggagtgagtggcttatcctagagaaaaaaagttactgggctacaggagaaggcatttgtgagtttttcccttccctcccctccccaccctccttccttctttccttccttccttccttctttccttccttccttccttccttccttccttccttccttccttccttccttccttccttccttccctccctccctccctccctccttccttccctccttcatctttcacctcccttccttttaattttgctgtgagcccttaaagaggattttagtaatttactacttaaattaaatatacgtcctaggtgttgtgctaggcttcaggaatacaagttgaattgcagtaatgtacaggcctttgcattctagcaagaaaacagatgggtgtgtacgtttgtttcctcagtgctacattaaatgaaatggatgggagccaggaggggaaatagtgtgtttggcctgagaggttagtagcaaggacttctccacaagaaattttgaacccaattcttcaagaatgaacacctttttgctgggtgaagagtagaggaaggcatttggggtaatagaaatagcacaaaagataatgaggtttgaaaaattacatgctgtgtttggaagaatgtccggagcagtggcattttaggtttttaaagaggacagtgacttgatcagagctctgtagtgctttgagtatgggttgaaggtgagtgtacttggagactggtgggcatttaattggtgccttccaaccacatgaatgaatgtccccttaaatcccttggaagcactttgatcctagaaaattcaagaattgtccccaacatctttttcctctgagttggtaccctggatctttgggtcttcttttctttccttttttaatgtttaattttgggtaatgaaagtcgcacaggttttgaagccagcagatttggcttcaaatccaagtttcagttgcttgccagctttacgggacaaattatatatcttttctaaatactcatctattaggtgggagaaataattgctatggcataagatttttttttttaaagattagaaatcacatgtgtacagaatttagcacagtaactgatggatattatttctattacctgttatttttgtcttctagttgatagctccttgctaacgtctagctcctttccaaagctcttcctgagtagggccagtgtgtagtgctgcaggttgctaaggcttctcctggcttgctgagttgttctagtttttgtagcaccttgcgtgctaacccaccccgagcacatgctctgaaaacataacattcagaggaaggttgaggactgagagacaaggtatatctttgaggaaattcagatgcttgtactgaggagatcaggaaaaccagacacgagtaatgattgtcgtttgtgtgtggcattaataaattttacaatagctaagtcctcatttagttattctatgtcacagataaagacaggacagtagtatttactgtgttaaggtactggtttcccagatatcttacagtgagaagacagaagctcagaaagtgtaagcaatgtgcatacttgttggagtctggatgtaaacagagatcttgatgccaagcctatggaactttgtctccatataatattgtctctttcatggataactgactgccatgtggcagattattcacgctattctgacagttatggctttaatatcatcttattttcccaatctattcaaggatcagttttgtcttattttattttgtttaattccaaattggagatgtagagaaaaatcacatgacgtttgatttgccagtctcctaaaaagaagaaaactatagatttttaatatacttaatttttttttctttaacaggtatgtgagaaagagagcagtcccaaattggtggaactcttattgaatagtggatctcgtgaacaagatgtacgaaaagcgctgacaataagcattgggaaaggcgacagccagatcatcagcttgctcttaaggaggctggccctggacatggccaacaatagcatttgccttggagggttttgtataggaaaagttgaaccttcttggcttggtcctttatttccagataagacttctaatttaaggaaacaaacaagtaagtaacaaggagaatatttttgacagttcttatttttaatagtatttttttaagtcactagtcttttagtggttattcatgccagtttgaaggaccttaagccaaaaatattgcaaaggtttggatttttttggctatgaaatacttcaaaatgatgtatttaagttctttatgagatagcaaataggtacttataaaattagagcaaaatagcggaagctttttgaagagctactttttaatatagtccttttttatttttaaagtaaagcatccttgtttttttaaaaaaatataaaattataaaaaagaaaataaaaataacttattttttcccttttaagtaattaaaacggatatttttcctaactttttgtatgcttacatgtacctatgcattcaaatgtatgtaaaagcatacacacatattcacttggcatttttaacttagcatatatatatttcaattgataatgcattttctttatacattcaagctcatatgtattttgtacatattatgtgtattgatggtaagttgccatcctctgacactgtttttgtcttttgagctctttcatttgttcacactaaatgtgtttttagcgtgtgagctcccagctttttctatgttaatttagtctcatgcccatctccttccccatggtcatgatactccatgactcaacacctttaggaccattttgcaaatagcatgtttgcttctctcatttttatgatgcactcaatagcaaaacaccagttttggtcagtctactagtctactttttccctcactttcaccaagataactgagtgctgctagagaaaagtacccgtccatgcaatttggtgcctttatacatcaaggtttccaacctctcagtaggctccaaaagttccagtcaggctgaattttcctcggtttctcaaacacttcatgtacccttacttccagtctttttccattgttactctctctacctaactctaaattctctcttcacctggctgtctcttcattcttcctgtctcagcaccatcatcagtctggaaggtcctcttacatgaccctatagcaccttatttctcacctatactaccattcaccacattatataatttaatttttcatttttattatctactttttggtagattgttagtaccatgaagtcaatgtcagttttgttcatggttgtaaccttaccattgatacgagtgctttgcacatagtagattgtcatttagaattaaacatttaatattggcaaaaataaaaattatgtaatacattatgttgctaagcatatgtggaaacatgcttcatacattgatatgaatttaaattgtcctcttttgaggacaatttggcaatatccactaatattttttaatatacaaacatacttttttgacctagcagtgtactgttaggaatctatgatacagacattctcaatgtgcacaaaaaattatgtacaaaaatgcacattaaaacattgtttataatagcaaaagagtagggaaaaacctaagtattccccaaaaggaactattcaaataaataatggtacattcatgcagtggaatgctttgcaatcattgaggaaaaaaaaaacatatagcaaatttaatgtcttgataaagattacattactccatggcaaaaaacaggcacagaacagtgtttttactgtgctaatgttgatggaaatgcaattggaatatgatagttacaaaagtttgaatatgaaataaaaccctccagaaatggggtccctgattgtctctggggtctttggaaattactgagacatggttagatcccatgtttcattacttaaactagtctcatgccaaaaatctgcttactttaatcttcgctgtctgatagagaggaattgtgggcccattggagaaggatggaggagatttatcattcactatattccctttgctgtgtatgaagtttttaccattgacacatcttacccaattaaaagagcacagcaatgtcatttgattaattggagggtataaccatgatttcattggcagctggtctgagtaaagaacactttgggtcatagctttcaaacatttttcaggtagtatttgcctgagtgacatatatgtgtgtgaactcatcctgctgggcttcgggataatttcccatatcgtaacatattactctggaaaaaaagaactatttgggtatatgggtatagtgtaagccacagtatcaaatgtcttcttggggtttatcatatgggctcaccacatatttacagtaggaatagatgtagatacatgagcatacttcacctctgctactataatgattgctattcctactggcgtcaatgtcttttagctgatgagctacacttcacggcggtaatatcaaatgatcccccaccacgctctgagccccagggtttattttcctttttacagtaggaggcctaaccagcattgcattaaccaactcatcactggatattgtactacatgatacagtggtatccttaactttgttaaaggtagtaatgttaataagatatttggtaaaaatggagtgagggacttttttgttaatatagtatgattgaaaacattggttgatagaataaggatatttgagagggcaaaaaatgagagttgttccaagatattgtgtctcaagtcaaaccatttttaaaaatcaagtgtagtgacttatatacatatataatttatataaaataaaatgcatatatataaattttatatataatttatataaaattaagtgtatattttcatgtgctttgaaaattaccactgtatcatgtagtaatatttgaagtaattacagtagtaatatttgaagaaatcttcctggctgtatgtagaacaatgaggactctgtcaacttattcttcatagtagagctgatatataatgtaatgaagttgtgagaagaatgttaattttgaaattccatcaaatttcccaatagtcataatgaatcactcagcaaactttataaaaataacaacatcctttatttagtattttttgtgttctatgcattgtgctaaacattttatatacatggtttcatttactcttttccattaccatatgctgtgtatgttatcatcttcattttccaggtgaggacactgacacccatggagcttatataactcacaaatggcatttctatgacttgaacacaggcctgtctggcttcaaagcctaggccttttcctgaataaagttccatagagattcaattttgctatctacaccaaagcattgtatacatggttatgtttttttttaaaaaatatgatctgccacctgctaattatttaggatcactaatgtaaggtgactttggaaggaaaaatagaaattttctctagaagcataggaatacataagaattttggtcctatatatgtttatttttgcataattgttgatttctaagttcctggtgcatctctttattttcagatatagcatctacactagcaagaatggtgatcagatatcagatgaaaagtgccatggaagaaggagcagcctcaggcagtgatggaaatttttctgaagatgtgctgtctaaatttgatgaatggacctttattcctgactcttctatggacagtgtctttgctcaaagtgatgatctagatagtgaaggtatttattataaaaagaaatccctttatgttttacatttacacactgacattgaacaataggacccgagacaaaaacctgacttaaatcatttggaaaaacttaagtagaaatgtgtttattatcacaaacggttaggtttactaattttggtcaaagtgatgtttcaaggaagtgtgtctctgtgcttctaaatgttattctgactaattggttaatggttaatattccaggaaataaactctgactagactggaacgagattccacactctgacactgactaaatccttttgtggcttgtgtaagctccttaactttgttaaaggtagtaatgttaataagatgtttggtaaaaatggagtgagggactttttagttaatatagtataattgaaaacattggttgatagaataaggatatttgagagggcaaaaaatgagagttgttccaagatattgtgtctcaagtcaaaccatttttaaaaatcaagtgtagtgatttatatacatatataatttatataaaataaaatgcattcactttaagtgtatattttcatgtgctttgaaaattaacatattcatgtagtcatcatcgctattaagttatgcaatattttcatcatccaaaaaagtttcttcatgcctcttcactggaaccgtccccttcccctgcccctgtcccttagcaatcatttgcttcctgacactgtagattaatgttttctctagttttatgtacatagaatcatacagtaagtactcttttgtgtctgttttccaaagtggttgtactatgttctccctccaccagcgatacatgagcattctggttcctctacatccttgtcagtacttggtattttcaagttaattttagctcttctagtggagatttaattcatttggatgtaattttcatttccctaatgacattttcatgttcttattggccattcttatttttgtgtgaagtgttgaagtattttgcttttaattgggttgtcctacaattacataaaagttctttgtatattctagatagaagttgtgacaggtgtatatattgcatatatttttttcccagtcatagcttgtcttctcattttactaattctattatttttaaaaaacagaagttttaaattttggtgaaatgcagttttccagtttttttcttttatggtttgtcctttttctataccacttaagaaaccttttcttagcctaaatttgtgaatattttctcctatattttctcttagaagtgttaaaatctcagctttaacatttaggtctaaaacattttaagctgatttttgcatgtgatgtgtcaatgaagggttgacacttatttctttctgtgtggatatccagttgttccaacattacttgttgaaaatactatataattcctcattgaattaatggaagctttgttctctttaattgactatttaggtatggttctactttagcattatttattctgtgccactgatttataccttattcttatgccaaaaccacactgtcttgattactctggcttactagcaggtcttgaaatcaggtagtccaagtcctctggtgttcttttaaaaaaattgttcttattaatctagattatttgcatttccatataaattttgaatcaactaactttatgctgggatttttattgtaattaagtccatatttggattttatattgaattaatttataaattaaatcatattacctgtaatgttaatataatctataccatataattaatacataaataatttctatagattatatctgtaaatcaatttgagggaactaatacattaataatgagtcttttgacatattaatgtgatatatagttcaattagtcttttaaaatttctaacagtgtgttgtattggatgttttctgatgctgttatagatggtattgtatttgaattctaatttccaggagttcactgctgatatatagaaatacaattcatttattagtacatgaattttttatccggtaaacttgctaagctcacttatgagttttccagtaccttattatagattccacaggattttctttgttcgtaattataccatttagtaataaagacagatttgctttttcttttctaatatttatggctccttttttttttcttgtcatattgcactggctaggacctccagtactatgttgaatagaatcagtcagactgggcaccattccttggtttccaaacttagaggaaaaacattcagtctctaatcactaattatgacattatttgttatttttcatagaagccctttatcaaattgaaggagcttcttcctagtcatttttggagagccttttttttttttttaatcattaataggtgttgaaaaatgctgttcagcatctgctgaggtattcatatttttcacctatattttgttaatatagtcaaatacaccgactgattttctaatgttaaaccaatttgcattcctggagtaaatctcacttggttatggtacattatcctttttatatagtattaaattttattttctaaaattttgttaagaattttgcatctggctgggcacagtgactcacgtctgtaatcccagcactttgggcggccgaggcaggcagatcatgaggtcaggagatcaagaccatcctggctaacagtgaaaccccatctctactaaaaatacaaaaaattagctgggcatggtggcgggcgcctgtagacgcagctactctggaggctgagtcaggggaatggcgtgaacccggaggtggagcttgcagtgagccgaggtcatgctactgcactccagcctgggccacagtgcgagtgcaaaaaaaaaaaaaaaaaggaattttgcatctgtgagagatattagtctgtagttttatacttccttgtaattatgggagtaatgctggcctcttgaaatgaattgggaagtgtttcccattccacaattttctagaagagtttgtgtaaaggtgttttcttcttaaatgtatgatagacttcaccagcaaaggccatctaggttttaaatttttgtggggaggagatttaaacttatgaatttaataactttgatagatgtatgattattttaattttcttttacttcttaagtcagttttagtaatttgtaactttcaaggaatatgtccatttcatataagttgccaaatttatttgtttaatgttacttatagtaattatttaattatcctgttagtgatttagttatcctattaataatctcttcaaagaatcagatttttgttttattgattttctctattgtttgtgttactttctcactgacttttgttcttatctttattgttccctttccttacttattttcattttaattgactttttttaaatagattcttaatttggaagcttagaactctggtttttagaaccttcttattttgtaacagaaacatttatttaaggctatatatgtccttataaatatcactttcactgcatcccagtattttgatgtgtcatctttccattcatttaaaaaaattttaatttcctttgtgacttctttgattcatgagttatttagaaggctgtcgtttattttccaaatatttggagatttttctggataactttttggttattggtttcaatttaattttgttgtggtcagacaacctactctgatgatttctatccttttatatttattgaaacatgctttatggattattatatgatctgtcttggtggtgtgccatgtgcaactgaaaagaaagtatattcatctgttattgggtcaaatcaataggccaaattgtttggtaaaatttctcaagttttctgtgactttactgatttttctttctatttattgtatttgaaagagaactattgaagttgtaattgaggatttgttggtcgtcttttcagttttatctgtttatgctttgtatattttgaagctctgctgtttgttgtgcaaacgttaaggattatatataaaaaataattttttaagtgaaataaccactttatgttaatctaagtttgcagttagtatcattttcttcttctggaagaattcccttttacatttctagtgcagatcttccagaaacccatgtgcagattactggagctatttttctgtaactgccccagaactcccagctattgtagtctccataaatgttgatgtctatctcctcatctcaggaaagccgtgagactgtttaaatttcttcttatgtgtatgccccttaatttgtctccaagcagaagaccagagtgatcatagggctcacataatttgttacccttctttcaggtattacatagtcctgtgctgtctgtcgcccagtgtctatatccagtcatttaatgtatttgtccagttttcttgttgtttatgtaagtaggttaagttcattcacatttgttgctctatcatgcctgaaagaactctcttcaagtatttttaaagaaaacattagaaattttaacataaaataattataaaatgcactatgctgcttgtacaaataatgtgctaatagacatttcacaaacatataaagtgggataattatgataatttaataatctttataattatgtaattgttactaaattataaattctattttattaaaattcttaagcattaaaataatttaaattatagaattaattgaacttcagtaatgaaccaggtaggaactgtttatatcaggatttatactgaatattataaaggggatatttggatatacagattttataatttggttttgaagtaaaatgaattctttgtttttctaagataaagagtaggggaatttaaaatcataattttcacaaatgcattcacattatttatctttaatatgatttatttattgatcttttttgtaaatttattattttgaaagtactgccttttccttattttataaaataattattgccagccaaatttattgtgtttattttaataccattccataaaagaaaccatgaaacatgaaattcagataggaatatattcaaaattgctgttaaataatttgtgtgattacaacatttaaagcaagatttgaaaaatttataagaaaaattcagggagttaatccactctctttcctttgctgctagatcctattccagtggtctctataaaaaaaattcagagaaacagaaagcagtaacattgatcagattgcatacaaactttctgcacacacacgtatttgttatagcttatgtaaccattgattgattttgcttttttctgctggactatgagctcctctgagggatagatttatttttttcctgcatatcattatccagtgcttacccagtgtctagtctgtaacagccattccataaatatttatggatgaagaaaaatgttgttgaatttttaaagtgaaaaaccaacatggcttatcatttctattttaaagattttacaaaggaaatggactgtgaaatttccattaataaaaataggtttaatcttccatgactgaacaaggaccttatgattgagtaagcttttcatactcactttcatgttactttatcattttcaaaataggaagtgaaggctcatttcttgtgaaaaagaaatcaaattcaattagtgtaggagaattttaccgagatgccgtattacaacgttgctcaccaaatttgcaaaggcattccagttccttggtaagttgaattgtgattatgttgtgttttgctactgacattctcttgataactaaaatttatgccaaagctaggaacaattggtagggatttccctgatgtatgaaaactataattttgagatgttttctatatgtatatatatgaaaacacagtagatgtaaattatgctaaattcacatttgtagtcttttgagtatgcagggtatgaatttgtttggggcatatatatgtatacttgcagtacacttcaagatggttttcttcttctttcttttcagaacttcatgtctgaaaagagcccaggctagacctgtacctaatggtcccatgaacactttagctagaaaccttacagtgatttctaagaaaccagacagaagtctgaaggacactgaacaagatggagtagcataatataattcattgcttatctttgtctatgtctatatctatatctataagtgtattgaaagttatttaattttttagacaccattattattatttcaacctcctatctgttttggaactatagaaggactattgcatatttgcatgaggagtttgatcattctagttgaggaaattgggagccaccttattctcaggttcactttgaaggatctattctaacctatgctctaattttgattatagctgaatactaaaaatatcagtgtttttatatgttaattctagaccttaagatgggtgaaatgaatgactatagttgaatcggttaaattagctctcagctttatatatgctctttcgaatttatatataaatttagttataaaaagtagtttggttaatgagagaaattatatagatatagctttttgactcaacctttctgtttttcagtttccttatatttaaaacaaaagagaaagagtagatactaaggtcatttgagcacaaaactgaattgttttcttttatcttcataattgggttcttagtttttacttgcctattttttcccataattataaataccatttaaccctattaaaatttcatggttctttccttataaaaatgtcctcttgtccaacaagtgacagcaattttattataaatatcattttttttaataggggcccatttttgatcatgaagatttactgagaagaaaaagaaaaatattatcttcagatgattcactcagtaagtatttggatgtaatcataagtaaatagatactttgggcagaatacagtgtttggttgaatttcctccaattattcaaatattcttggggccagtttcatcttacataatttcccataagctatagaaaaatgaagtatacatttaaaatttacctttcttgaatattatagaacacgttagtctttatttttacaagttttctgaagtgtaaataacacctcccaccagtgccactcttcatcctctcttccagttttctttttctttttcccacaccatttataccacctgattaaacgctttttatctactgttcatctctgccactggaatgtaaactccatagtttggttttctactgaatcttcagtgccctgaagaaagcctgattgctaggaggtgctcagtaaactttcactacatgaatttaaattatttgcttatatttccattgtctgtctgtttttgacaaaagggtcatcaaaacttcaatcccatatgaggcattcagacagcatttcttctctggcttctgagagagaatatattacatcactagacctttcagcaaatgaactaagagatattgatgccctaagccagaaatcctgtataagtggtcatttggagcatcttgaaaagctggagcttcaccagaatgcactcacgagctttccacaacagctatgtgaagtaaatttaatttatccttgtaacttttaagacgtttgaagagcttttgtatttatatctagtttgcctgattaagtcttttaaaagaacattctgcttttgtgtcactgggcaataagtcccccgttcttctggtttttgcacacatatcttagtctgtgtgatgttcaggagcatctttgagggcaggccgtggaaacagatctgattaaaaagaaattctaggttttgtacagagtacatgttaaagtctatcaagtgtatattgattaaactttaatcatttaattcaagtaagacaacgtcaactatttaaattagattaggtaaactagaattagacctggtttggtagtactggctctgactcagctacaactgtgtgacaatacgaacatgtcactcctcctgctctaatctttcattttctcatctgtaaaatagagattcaactaaatgattattgtggcttattttttttttccagtttaaaataatgtgtaacttaaaagattttcatttttggtcaaagttcctgtcttataagaattaaactataatatagtttgttgataggatagctctctgaaaattgactttgctcaacatttgtatgtactacagatcaaaatagttttgaaagccaaagaagatatgaaaattaaaattattttaatgcaaatgtttaaattgttaaattaaattctcaaggctgggcgtggtgactcatgcctataatcccagcactttggaggctgaggcaggcggatttgtctgagttcaagagttcaagaccagcgtaaacaacagcaaaatcttgtctctaccaaaaatacaaaaaattagccatgtgtggtggggtgcacctgtggtcccagctactgggtgctgaggtaggagaattgcctgatcctgggaggcagaggttgcagtgagccaagattgcaccactgtactccagcctgggcaacacagtgagaccctatctcaaaaaaaaaaaaaaaagtcttgttgcaaatgcatttccccctttttaagtctaaaaaattatcataattttgagatgttttaaaggcaatattacataaattttaagtatatttaaggggtgtttttctctgtaaagtttttatatctggagacagagagaagaaagaaaggtgacccactcctccagccatgctgtaatgtctaaaatgtgtctttctctcttcacctctttgccttgctaaatacttcaagtcacccagggctcaatttaaatgtcacttcatcactctctgcttctcttcctttttccttctaccctccagccaacctggccacctaacctccatttccataacacatgatgctttccctctaattctcattcagtcatccaatttgatttaaagtacctttgccttcactaaactgtgaactccttgaggacaggacttgtttcaggcttgtttctgtctattcccagtgcctagtgagacctgacatatggtagaagtttagtagatacttactgaattgatttgtggaggcattaatgcctgaaacttggtaatacttcaattaatatttgttaaatgagcaagtgaaataattcagagatttagtctagttaaaacaaagagaattggaaggctgggcacggtggcgcaagcctgtaatcccagcactttgggaggccgagacgggcggatcacaaggtcaggagatcgagaccatcctggctaacacggtgaaaccccgtctctactaaaaaatacaaaaaactagccgggcgaggtggtgggcgcctgtagacccagcaactcgggaggctgaggcaggagaatggcgtgaacccgggaggcagagcttgcaatgagctgagatcacgccactgcactccagcctgggcgacagagcgagactccgtctaaaaaaaaaaaaaaaaaaaaaaaaaagagaattggaagagatggtgataaggtgagacatgctggcattcaatgactggacaagctcagaaccttctcttagggaaatttcaaaatgacaccattagatggtactttgtttgtttgtttgttattgtcaaagagtctcaactatgttcctttttataagaaaattttctgattaaaccctgggaataattttaaaatctttactttggaataagttaataagggtctgaaacaaaggcaggaattttgaaacaacttctgaggcaaagagtcattaataagcctctataatcatatcaaagtctagaatttcttgtgtggataaatatactgatatataaagaagaacatagagaagtgattgtttttggcatttgagctctttaagagtattacatacaaagttgtaaaaagtcgacataatatgtaagtaggggtttgctgttatcattgtaaaattataaactgcttaaaaatggaaagtagaaatttgaaacaaaaagtttcataaaaaagaggaggttctaaaatgaaacacatattgtatgtaactatttttatggttaaatcttatatatatcaaaatatgtaacaatttctgacagcatttaaaacatattcccaggattatgttgtgctttttcttaaatcattaattcaaatatttgctgaggcctattctgcttccattttgctctttctggaaataatttacaaaaaagctgaaggaagctttcaactctattttcatgaacctgctttttacagtctaccgttgtaattttgctggttttacccatgctataagcagaggtgattgggctaatcagtatactgaaattctgttgtggattgtgttttcaactttttgaaaattcttgatggttctagttatcagaggtgtgtaaggcagaaatattagctagacttaagttcctcagatggtccactttagaattttaaactcttgtcttttcagactctgaagagtttgacacatttggacttgcacagtaataaatttacatcatttccttcttacttgttgaaaatgagttgtgttgctaaccttgatgtctctcgaaatgacattggaccctcagtggttttagatcctgcagtgaaatgtccaactctgaaacagtttaacctgtcatataaccagctgtcttctgttcctgagaaccttgctgatgtgatagagaaactggagcagctcattttagaagggtaagaaagagctcattaaaaataaaaggactgcctaaatatgctgatgttaacaaaatacgctgacatttgtatagtcatgagttttgacaacatggtgaaactccatctctactaaaaatacaaaaattatccggggttgttggtgcgcgcctgtaatcccacctactcagaggctgaggcatgagaatcgcttgaacccaagaggcggaggtcgcagtgagccaagatcgcgccattgcactccagcctgggtgacagaggcgagactctgtctcaaaaaatatatatatatatatatataatatatttattataatgtataagtattattatatataataaaaaactgagacaatgaatattacaacttttatcaatgacttacattttcacaactaatttttaaattaatgagtcctcttcgatgctattcttcgaaaacaaattgtttttggtattttttctttaaagcatatgaatttatgcagtttaatcattatcttgtctcttgtgactagaaataaaatatcagggatatgctcccccttgagactgaaggaactgaagattttaaaccttagtaaaaaccacatttcatccctatcagagaactttcttgaggcttgtcctaaagtggagagtttcagtgccagaatgaattttcttggtaagtgttctgtgtgggtctcctccttaccaggccctctaagttgtacaagatgagtcacatatggaccctttaggtggggattgaaaggtggcatttcagtttaaatattatgctggatttaaaaaataaagtcagcaggttggcaataaaagaaaatgctatcaaactatgaaaataaatgaaagaaatgtaaatgcatattgctaagtgaaagaagccaatctgaaaaggctacatactattcgttccaaactataagacattctggaagagacacaattatgaggacattaaaaagatcaatggttgtcaggggttaggggagggagagatgaataggtaaagcacagaggatttttagggcggtgaaactgttttgtatactacagtgggggatacgtgccattgtacacttgtcaaaacccatagaatgtacagtacaaagaatgaaccctgatgtaaactatggactttgagtgataatgaagtgtcaaatattggctcatcgattggaacaactgtgccaaactaatgcaaattgttaataacaggggaaaatatatgtggggtagtggtggtgagagaagggatatattgaaagtctttggactgtctgctcaatttttctgtgtatctaaagctgctctaaaaatagtctataatttaaacaaagttatcacatttttattgtcagaggttaaaatgatagttacttggcctactgtgtagtgcactgtggttccttttagtcttcaactaaacatgactgcctgagctgggtaaggcatccttatactgaaatactgtttttcatactgaagtttcttcagcaattttttgtatgataaatatgattactcttattgctgttgttagaaacaaaattaatcatttaatagttttcaatttagtgaagttaatgtatattcaatcagcccttgtgctttgtaagacattacaataatgcaaattattatcatcacttttattaaaagttgtagaatcccctgcattctcttagcttatgaaataatagaggaaattatgttcatttgtatcctaaatgaacattttaatattaaggaacaaaatacttttatgataataaacaggaattccccatattttatcttccttcatagagaatactcacttcttgccacccatgtgattattctatacctgactcagtaaaataatttttaattctatttaatagcagaatatggcttgactgcttattaatggtattttaatttgtcagagctttcagaaactaataatgatcaaagccatcttaatttggatagtattttcctcatttatccctccctcccttcctcctactctcatgaatattggccacattctaactatgatcctgaaactggagatagagtgattcactcactcactagtaagcaaagcaaacttggtctctgtccttaaggaacttgtgattaagttcagaggacagacaaacattaagtaatgatggcacaaataaatgtaattttatattgtggtaccttctgtggaaaagtttcaggatgctctgtggtacctcaggggaatctgattcagactgtggagtcagggaagcctttctgttcctgtgacatttaagttgggtctggaaagaggagcatccaaaatgaccctgaagcttgtgtatggtcagtgtgtcatctcagctgaatctcacaatgatcctaatggtcgtcgtacctaggacaggtatgacctctgcccagttgaggaaattgaagcagcgagatttttttgtgtgatgtttacaggtgcatgtaattaattatcttgtgaaagtttgaatgggccccagttcaaaatctgtttgctttgcactacacaagcttaatagtttgaaaagtggtcttacatttgagaagatgccccacggaggtgacatctgagcaagaccactaaccattaaaaaataatcccatgtaaatggtgaaacctcgtctctactaaaaacacaaaaatttttagttttttttagtaagcgtggtggcatgtgactctaatcccagctactagagaggctgaggcaggagaatcgcttgaaccagggagtcggaagttgcagtgagtggagatcatgccactgcactccagcctggtgacagagcaagactctgtaaaaaataaataaataaataaataaataaataaatcccatgtaaaatatagttttagttttgtggccttatgaatgttttccatacaacatatgaaactcaagactctgaagtcttaagtggagaatcatttctactcatttattttgccaataggtgaggtataatatgtatcattctgcttctcaggaagacagcttctgggagtgtcctggaacattttgacccttgaagattgtctagataaatcataacccgtattttttaaccttgaaaatgctaataactaattcctcaagccattttcacagaaccgtagatttgtagatatttcacgtatctcagcgttcatctgatctagctgcactcttttacagataagaaaacaggctgtgtgattttctgtttcccaaattgtgtttcacagaattttattccttggaggtacctcatactgcatttccttcttaagaattcacaaaataggccgggcgcagtggctcacgcctgtaatcctagcactttgggaggccgaggcgggcggttcacgaggtcagaagatcgagaccatcctgnnnnnnnnnnnnnnnnnnnncgcacctgtaatcccagctactcaggatgctgaggcaggagaatctcttgaacctgggaggcagagattgcattaagctgagattgtgccactgcactccagcctgggcaacagagagagactctgtctcaaataataataataataataataataataataatgtaaaaaataaaaaagtaaaaaataaaaaaaatcataaaatacaccagagttttgagaactcagatattttactttattttaccgaatgtttcccaatctcttaagattatatggtcaaagaatactttcattaaataacacccattattattccatagaacactctttatgagctagtactataaataatttttgtccttataatatgctgtatattagtaaagtgttcaaagttgttttgctatagttatttaagagtaattttagttaatctatatgatatataataacatcacacataatttgaaatgaatattctaataatttttactttgtacaaatgttgggtagttaaatttatatttaaatagctgtttagcttccaggttaaaagattctggtaagtatggcattttgttttattgtttagtggaagtattaaggctattactttatttttaaaagtggatttttaaaaattgtcagtgtgagaatggaaattaaattaaattaaacaccattggtagctgttcttatttttgaatttaatggaaatctggttaaaatgattaaaatgtttatctcattttttttcttttagctgctatgcctttcttgcctccttccatgacaagcctaaaattatctcaaaacaaatttacatgtattccagaagcaattttaaatcttccacagtaagtttattgtttttttaattttaaaagcacatcagctggaacagaacctttagaaacatgatttcgattcagtcatatggaggtaattgctttctaaacctacttagcttaatgtttttgtgtgtatgaatgattttcacttgataaaagacccaactcattacttaaaatggaaacttttatattaatttagtggatcattgtgtaaaaacaacttaggattgtttaattaattgctgtattagtataatgaaatgagagtatactggctatcactttaacttttaaaatgttagtggaacttgatatgttgccagaatacccttaactttgacattatgcttaagttgtgtttgagtgaaattttgggtgaagattaggcaagtttatgtagttccaggtttttgaggtattttggttaatttcatgaaaccagaagtttcctgttaactttaaattgaggcattaatttgatcttgattgtgttgtaatcttaaattctattctaattatatcatacatgataaaccaaattcataaaatatatgtgtaaatctatcttttcctttgttttcttgctgtcagctattccttcaaacactgtggctttttagaattaagactaaaatgctacttgcatgatgctgcaatgaactcttctgtgagctcatatttagggaaataataattataatttagccatagagagtgttacacaaacctataatagctaacttacatctagctttagaatgtgtcgaactattctaactactctacagcggttcgcctctttaatcttcctaataatcccctacaatagccactgttattatctccacttcataagagatgaagtaacttgcccagctcatggttcttaaactctggtggttcaacttcaggctctcaaatcacatgcatactcatatgtcaataatgctagttttgacattacaccttattctcaccctgaggaaaattatttgtgatgttatttcatgtattttggaaatactcatatgatttacatctttccattgtattgttttagcttgcggtctttagatatgagcagcaatgatattcaatatctaccaggtcctgcacactggaaatctttgaacttaagggaactcttatttagccataatcagatcagcatcttggacttgagtgaaaaagcgtatttatggtctagagtagagaaactgcatctttctcacaataaactgaaagaggtaagatgtcacttttaaaattattgccacttaaaaaatatactttatgatttgcatcatcacaaattatcattttaagtgatatttagcttctaaataccagtttcatgaaactagaagcttcctgttaactataaattcctgtcaactataaattcagatttccattaaattcaaaaataagaacaactactaatggtgtgtcacttaatttaatttctattctcacactgacaatttaaaaaaatctgcttttgaaaatatttaaaagtagtagctgtaatatttccactaaacaataaaacaatatacaatacttatcagaacctttcaatctgaaagctaaacagctagatataaatttgtctacccaacatttgtacaaagtaaaaattattagaatattcatttcaaattacgtgtgatgttatcatataacatattatagattaactcaagttactcttaactgttacttaactatgacaaaaaaacttagaatgctttactaatacacagttctgtatagtactagctcataaagagtgttctatggaatagtagttgatgtcatttaataattataaattcaaaataagcattgtaaatatcaatactattcaatttttttggtttttaaataagttctaagcctacccaatggtaaatggatatggtaacacagcgtaatttccttaaaaaatacttttgtgctatattttttaaggattatatgaattatacataattatagattaatgttatgctgtgtgtcattgtatcactaaatctctgtccaatctgttaacagactcttagatgctccatttttctcaagttgttgctggcctgtgtactatattacttgtttttcagctttctttggtacattcttaaatttctgcattcctgcaccatgctacctatcaccctaatggatcaatctttttgttttgctccattctctctgttataaatctgaaattgataatctatttgtctcagaaaatatatttttttcaagttctagcgtgttgcctacaaaaccaaaagaagtaagtgtctgacactgaggttcagaaaaactgtgcatatattttgctacctgattttttgccagcaaatgagtgttttctattataaatacagtatatattacttaaaaatttggaacagaagagaaatcactccaattaggatgccgcctaaaatataagcatgttgctttactttgagaatactaaattgcgtgcaggtttgtagtgactctaggtcttctttgctttactgaaggagcagaatgaagccacagataatggatttggataaccaaatccattttgtggtaagaacttccttactttcaatgtcttgaagagatgaagtatgttaccaaaggagatggggttttttaagattacagatgagtgacatagattgtttgggagtaagtttttatatgtaagttttcatgtttttaaacacatactgacaacttatgacaaacctttggaaagttttagaactctgttgaaagattgtgcaagctgctgatggaatctgtgagcctttcttgtttcttatcatcttgttttttggcagaatacatttcttccttcccaccaacagcttttgcccatttttttccattaagattcctcctgagattggctgtcttgaaaatctgacatctctggatgtcagttacaacttggaactaagatcctttcccaatgaaatggggaaattaagcaaaatatgggatcttcctttggatgaactgcgtcttaactttgattttaaacatataggatgtaaagccaaagacatcataaggttagattttttttttctatttgtttttattaaatttatttcagattttctactttctgtgactttgatggacgtacattgttacaatttagggaaaaatgaatagtaatatttggcattaatatgctgtgtcatttgcctttcatttaatgaatgcgtttctgtggtgccactgtagagatttttcattcttcttagccaggctaatgttgagagcagcttctcctccttctgtttcttttcactggagtagactctaaaagaaaataagtattgtgatttggtctcttgattacacaatctaaagaaatatagcacagtttaataacttctcacactgaatttcatatagcaactaggtaacatatgcctcttacatcttaaagtattatcattactgacatcatatgaaattactaacttctattttgcccattaggatgagtaatctactcaccttgatcagttttgaaagcaccaaaacttctcaagtatcactgtttctggtctttacactctaagcactttaagtgtctttgataatggattttatccccctttttattccctttcagcacattggtcttattactttctcataaaatcctttgctcccttttccacagttactgtatgaacattgcagacctcatttctgtcatcacctctcaacttgaccgtaatatcccccaaggcagagactatagctgtgttcagtcactattcaaatcttggcacccaacacagtgcctggcatacaattagtaattgtttaattaccagtgatttatacttactcattctcttctgcctaaaatctcttaaatttgtatttaacttcatctctttttatgaggaaggattttgttttctgaactcctcctgagcttgatttcattttaaaggaaagaatttgttaacttttgtgctaattgtgactacccttcatcctacacaattatttttctctcttgaaactggaaaagatggttatataaaaattggttcaattcttactaaacatttagtagaactagctttcagtgtattatactgtattatcaaaatatatatctaaatatttttaaacatgtttaacattttcagagaagacagaaagacctggagcaagttagaaattgtaagcatcatttgctttttgaagaaagccatttttcgaatagtggtgcattcttaagaaataaataaatcaagaaaagtaatcttttttggtcatatcatcaggaatgttggtgagattcttattagtaataggaatgaattggtcactactccgatgtagtgacttatgatttagtctttttctctaatttgagactgtggcaacattttaacatatttcaaaatgtatctttatctatccattatatttttgataacactttaaatctattagtttaaaggtagtttttaagctacctaaacacttctatttagttcagtttttgcattaagatcattagggatgaaagcttgttaacagttgctgatagtataatagtttatatttatttatttatgaagtaaggtgatctcactatacatatatactattatatgcatatgtgatatatatgaatacatatctatacatcatatataccatatatgtgtatatatacacacatatataatgtaactaatatgaccttgttatcaagctttattataacagtatacatatatgtataccttgtttctatgtcatatggactttgtgaaattttatactttataatttatagggtttttcttttcttctttacttttctttttgagattgagtttcactgttattgcccaggctggaatgcaatggactgatctcggctcactgcaacctccgcctcttggcttcaagcgattctcctgcctcagtatcccaagttgctggaattataggcgcctgtcaccatgccctgctaattttgtgtatttttaatagagatggggtttcactatattggccaggctggtcttgagctactgacctcgtgatccacccgcctcagcctcccaaagtgctgggatgacagacatgagctaccacacctggcctgtaatttacagggcttttcatactatttaaagaaattcaaatatgtatacatgtatgtatgtatatgtgtgtatatttagatgtatatatattgcatatcgtattctaattagtattgcaaatgtattttggccttttgattatttctggcgatagtgtaacattttttctttggtgattttaccaaatattatcaaccacactaaaatctctagcaaaatatatgcattaacagtactctgaaagacatgtacattattagttatatgagctatacagtcttttggatattatattttagactagtgtgacatgcaaaagaactcacctaaatcttaagtgtacttttcaacagtttattattttatttttatatttcaaatactaggtttcttcagcagcggttaaaaaaggctgtgccctataaccgaatgaaacttatggttgttggaaatactgggagtggtaaaaccaccttgttgcagcaattaatgaaaaccaagaaatcagatcttggaatgcaaagtgccacagttggcatagatgtgaaagactggcctatccaaataagaggcaaaagaaagagagatcttgttctgaatgtgtgggattttgcaggtatttctttctatagaattttaaaattcacttttaccatttgttttgaacagggattcaaaaactgaactttctgttctaatatccagaaacctggtatactgtatagaattattccaaagccctttacttctcctaattttacccttgcctccagaatggaggagaacatggagggatatgttggtaacaatacggtgctaggtattttgatcggttggtgccatatatgctaaaagtggtcaatcccttgtaaaaacccagaatagttctctaaacattatctgttgtttttctcttattagtatgctaaataaaaaatagtattattcccccagatatttttttaaaaagagttcttgcctgttgtttgaaagatttaaaaaatttgtctctaatctttatttaggtcgtgaggaattctatagcactcatcctcattttatgacgcagcgagcattgtaccttgctgtctatgaccttagcaaaggacaggctgaagttgatgccatgaagccttggctcttcaatataaaggtgatttattctgatcttttgaaaatagaaaattgtgtgtgtgtgtgtgtgtgtgtgtgtgtgtgtgtgtgtacacgttaatttattttgggcaaacagttgcttcagtctctttaaatacttccttaaaagaagcactaaagttttgagttgggaaactttcagagtaattaaatcataacatgaaaatggtatgttccatattggtgaatgttattgataacccgaaattcttttatgctgtgaaacttgaaaatatatatgttcaactgtttttttaatcatattatttcttaaatgaaatctaaatttttctaatttaaaataagctatattaaagaaaagcaatctatatatatcatcaacttcgtactcaggggccatttagtgtgaaatccttcagattgtatcctttaagtggtcccagattattatgctgttatgtctggaatctcccttttgttgcttttgtatcttttcctttgttgtcttgttgtcagctatgccttcaaacactgtggcttttaagaattgagactaaaatgctgcttgcatgatgctgcaatgagctcttctgtgagcaaagtccttaaaaaggcttgtgtcaggatatttaaccatgtcatttggctgcatacatgcttgttttgtaatttgggtgttttttaatgtttcttttattaacttttttacagctagccaacatgagcaaatattacagtggcagtcatacttgcttgaatggcttttattctttcattgtagactccaaattgaatgactttaaaatgaatttagaagattaaattcactgataaggaagagaaaatatacatgatatgacgttaatttgatataatttgtgggtttatgaaatgcttgttttatttaggagtggataactcatcttaaggcatgaagatgagaaaggaaaactatgctactaccattatataggctacctaaaagggataaaaattggattaaggaaagcctaaaaatgattttttaaaatgtcgaggttacgttgttttcttaggtttaaggaaaaaaggacagttgttcttctcttcttctgaagtctgttagtttctcttttccactcaagtgaatgtcacggaaagcaaatatcaacaggaatgtgagcaggcccaatttgaaagcaaacacaagagggttttgtgtctttccctccaggctcgcgcttcttcttcccctgtgattctcgttggcacacatttggatgtttctgatgagaggcagcgcaaagcctgcataggtaaaatcaccaaggaactcctgaataagcgagggttccctgctatacgagattaccactttgtgaatgccaccgaggaatctgatgctttggcaaaacttcggaaaaccatcataaacgagagccttaatttcaaggtaacatggtaggctggtagagaaacgtaatttattaattctcatgttatacaactgcctagaaatgtcagaaattttgagaagtgagcaactcacttaaaattgtggggtttctttccccattgctgttagcattgttaaagtcttttccattttaaaattatttataccagacttcatttctaattcatagaaatgggaataaaaaaataattagaggaccctgagagaaactaagagaacatttctgggatactgagaaaatgtttctgagagagaatctgagaaaatgtttttgatgtcttttctcatccaacttcttgtagtggtggttcagtccaagggtaaaggtgaatactgaggtcttgggatcatctttcttctattattctttgactgttatttttccatttgctcctttcatttggaattcctattttatggacatcttgatcctttgtgccactccttcatgtattttgtcacggtgattcccattccaattttttttcccctctgtattgtgaggcagctgttttatttagtcatgaagaccactgacttggttttcggtagtatctcactaattacttagttcatacaaaatggactttttattttaggaattatgttttaaatgtttaaaattctcttctggtaagccaaatctttataaagcataaataaatcagttatcagagacaaccctctttttttaatacttgcaggaaaaagaaatattcactgggatctacaggagtgtggtgtaaactgtactgaaaaatacccttgatagttccatatgacaaatataatgatgaatttcacttagtccctcttggcttagctcattagcattaatgatcaagatcctggctgataaatagagtcctatttcgcctgggcagtaccagcgtaattattaatagtgtcccactatattctcaaaagcattccaatttggatgataaattatatagtcaccttggttataactccgcgttggccagttagcttacataatccatttatatagattatgtgtgcttctctgcaaaacctaatgagccatttgtaaaagtgatggattttgcggtgtccggggagagaatttgtatgtttgtgtccttcagcacacatttattatagttattaaaaggttttattgatgatagacagtaatgtcatgtaaaaatgacattatttatttgtagattttcctattctcttgttggacatgtaattagaaagtaatatgacttaaagaaaaacaaatacacaaaatttattcatccagttaatctcttaatcgaggtttttttttttctgagactatacccatacttcaaaaactttgttgttactgagaatattttgataatttcccttttcgtcattgctgtcagataatgtatcatatctttaaaaagacttgttggaggacgagtttgttttgaaaaggcctgaatttagttgatgcaaagtcacagataagatggctcattaagctgtattaatactgcttttgtctaatagatatcattaccaataaatcagaccagatttccttttggcacttgtaaatcaactttgaagacaactttttacaaggaagtaaaacaaatgctttgagaaataccagtattagtgaaagaaaagtatatattgctaatggatgcagcattctggcataatggtttgaaaactcatttgattgctttgtagaagagtgactctttcggaggacccagggcctgtgggcctgccagaacttgaaaattctttcttccctgaggtgcttcaacctgaattcaaagagcagcttttaatctattagagatctttttttgtcctctcatttatttttcatctttccctttgatcttagctcttctctaatctttttctgtctcaaccttattaacatgtgtctgtgcagacactttaagttttatttttttgactcagcctgtcagtgaactgattatcatgctgaaaggagaagcaggacaatacagagttgaatgccgacaatactccttttaatcttgttcagcccattagcagagcaggcatccctttaggctttgagacctagtcccctaaaactcatcccgtttctacttgatttgctttctttgagaactcttgtttacttttatatggaggtttccctccttggattaaaacataaacctcaatctgaagttccatttcatcttaatttatgaacaactctgagagggaacatgaaaagtggagattagtgaaattatctccaattctctgggtcaaaagatacacgaaaacagtctcttgagtaaccatttacaggtaaatacagaagtaatggttattgttgtctccttaaggttttagtcacaaatgaaaaagaccaagttaattttttgtctctgtgtgctgaatttctgtttgtagtaagtgtaagaatttaagcagaaatgctgtttcttattttcaggtgaaaagaatatgtaatttccataggtccagaaatagggagagtttgccatctggtggttcttacaggcattgcggatgttattaagagttgcttttctatttaaaattatattttaaaaaatgtttggaagatacttttattatagaaactatcctcttaagcccattctttaaaaaatcttcttttatgcatttctcattttgtagacagtgattagattctaaaagcaacagaacaatgatcatcctctcctagcagaatcactggtgtttagatgatttctcattttcccaaattcaaggttccatgaacaacatagcttgagtgggatcttatgtctccagatttcactgttgatatatgcatcccatcaatataacattttacaaataacaagcacaaaatttaatgttttaccttgaatatttaaaatataatatccaaaagctcttgtaatttgtactgatatcttatgctagcgtgtctgtttcacattaagtttaatgtcttaagatataaaaaatctttcttatggttagtgatttatcttgatttttgccatggaatttctgtgtagcaagataaacatttccataccattttatttgatatttcctaatttgcctctggatcaacagttttcctattttaatttcattgtacttattccttacaatctaaatagctttttattatattttgattttatttaaaaatgtacttctgaataacatatctgtttctgtaaaaactgttagcactgaatttgccaaccatttgacacatacacgaataaaatagatttttacggcttgtcatttgtaatttcatagatccgagatcagcctgttgttggacagctgattccagactgctatgtagaacttgagaaaatcattttatcggagcgtaaaaatgtgccaattgaatttcctgtaattgaccagaaacgattattacaactagtgagagaaaatcagttgcagttagatgaaaatgagcttcctcacgcagttcactttctaaatgaatcaggtttgtgtgtttctttccttactttcaaagctcagctgtaataacttataaaagtgtttctgaatcttgtatagaatttacattcaaagctgagagaatatccatacagttctttaatagggcactgatttttttctttttggaggatcatcatgtgtgtggatgataaatcatgtatcatgttgtaagaaaacaaatttagaaatcacctaggagtaaagtagtggaaagattccctgagtgggagttaaaatatttgggttctagaacttacttgtactattcaggagctgtggaaccccaagcacaaccatatccttccataatgtcaaatgagtttagtgcatgtgaaacttatttttatattgcaaaggggaattattgttggaatggtctaactgggacgctttgagaatcaatggctccctgagatgatgcagctgctgagtggaagatctagctctctttcatcaaatattggtctcaacgatgaaaattctcaaaccaacttcagtgctaattgtgtacttgatcatattactttgccagaaatgtgtgagttgtttgatagtactagagtaagtgactgggaagctgcttttgatccctagattctgttgtgtgaaaaatagcttcctgtggtttatgatctgttccttttccccattgttcttaaggtatgctgaaatatgccgtgtttcttatctgtatttgaaaataaaacatgtctttgtagtgtttattcagcaagcaaaacagaaaattatgaatttctatgtatgcatgaaatatgctttgtaatgcatgtcagtgtctcaaatatgtttatatatgattgttttatgtagtttaaaaatactccattataatattgggactttagaccataggatgcacagcttctagtcccagctctgccactcggtatgctgaaatttctttacctgtaaaatgaggaagttggactagattctttctaaagccccttgatatttgttctacattccatgtttcactgtttgatgaatttttactacaggagtccttcttcattttcaagacccagcactgcagttaagtgacttgtattttgtggaacccaagtggctttgtaaaatcatggcacaggttggtgtcttttatttttgtggcacggggttatggtcaaagcatagaacagatggcgcccagagcattgagcattttagagtttgggtttagttaaggcagaaacttttgtgaatttagaagactgtggaacatttcacatagaagactacttgaagaacttcatggaagaaggaaagatgtcttgagttcacttccatgacttggttttccagccacatacagatgtttgtaacactctgtcccatgctgctttactagatcctgatgatgtcatcgatttggttactgaattagtcaattgaacgaaggctttgtggaaatccttggggtaaacacatagaagaaaattgggttgctgagcctgtgaaacctctatctagataacatggaggggagttttgacttaagtgaaatgatctgaactttaaatgcttatgattttgaaaactttggatggcgttggttatagctgtttttttcttatatttcacatggaaaatgtttttctctccgaatgataatccattaccagtgagtttaattagttacaataaaccatctctgtagctttgacataaaagaccatttgagcaaagcatactacctcagggcttttcaaccccagcatgatgacattttgggccagataattctttgttgcacattgtagcatgttggcagcatttttggcctttatattctagatgtaagtaatatcctttagctgtgacaagcaaaaatgtatccagacattgctaaatatcgcttggagaatgtgaaaatgaccctagttgagaaacattaagcttctgatttgctgatgagtaaaatttatagttttgcatgtggctgcccgagtccctaaaattattatatatttttatattagagatatctcttccaattaaaccataaaggtaattaaattcactcagacagtcttgaataattgttcctaatttcgatctgaggaaaaaaaggaaggtattgtgaagagagaacttagtcgaggctaaatccagtaccatggaactcgagagcatattgaaacattgcagtcagtgattatttgcagtatgctagttattgctattttgggaggtatttttacattagactttcaacctttctacacatattgtcatggatcgtgtgattttactcaattattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttatattggatctacttggcaatttaaagaatgttaattaggaaatttaaaaaaattcagaactataaagaggtactcacgtagttttggaaagtgtgtcatttatgggcacaaataaaaaagatgtgtaggtagctgcatcctgtacagcaaaggaagttttaaatatatccagcaattttgttgtcctagttggcgcatggtagctatcaggaggtaactcaactccatatagtcaaggaaacgctatagttgctccctaaagtgatgtgtttccatgtcactatggaacacttgaaaccgcacacatatgaacattagggtgggcatatcttgtacagtagaataaggaagaggtttgcatcagaatcccccttttaaaaaaatgcagattttcactatgactgcaataaaattcctaaagattttgtggagtaattaagttgaaaatccatgaaagttcttctcattaacatagttataaatatgataacgtaagtaaaaattaagttaatttgagccactcagagttactttgaaagacagatttaaagtgtcaataaaatgataatttaaatttcttgttaacctaaaaaagaagtaccatcatttttatttatgccaataaattgaaatataatgtcattttctcactaacgtttaaaggaaatgaaagctctaaataatcaagtgaaaccaagagcaacttgtctgacagctattagcaaaaataaataagagtattcaccttcatgaatcaaggcaagggcacgaataatttcatggtgcagaagctctaatgagcccacccactctatgtgccccgagctgtaaggtcactaaactaattttaaaaaggtaccattaaggcaggtagaagcttacaagactcatttaactgtatgataaaagagatatgaaagggacctattgaattaatcaggtggaacattaaaaagcttatatggtaatttaaccttgataaaaatacatgggagaaatacaaaggaatttggaaaattctctttccttgaataaggcatcagttagctattcaggttattaggttgaaggaatgttaggagctcttttaaaggtgataaagtcaagataatgttgcagattttattcttacgtaacaaaccccctcaaaacttggaggcttaaaatgtgaacaatttatcatttctcattgttctgtggcttgactgggctcagctgcgtggttctgctccacatggtattcgcaagggtcattcacttggcttcattcagtaaactgagctggaaagtgcaagaaaggtacgtgcacgtttttggagtattggtgcttctccatgtggcctatcgtatggctaggttgggcttcctcgtggcgtggtgattacagagtaattggacatctttcatggtggctggttaccaagagaaatgaagcagaatttttctgtcctcttaaaggctaggccgaggactggcaaaagtattaattctgctacattctagtaaccagagtaaccacaaacctacctcagaataaaggggaagggaaatagactccatatgaatagcacctgtgtatagcgatagaaatgatgtgtccatctttggaaacttctgctgcaagtagtggtagcatgctatagatccactaggaaaatcaagcacaaactctttaaaaaataaatgtatcttagtaaaataaattagaataactagataataatggctaacacacatgaggttaatatgtgcttttcaaagattatctcatgtaattctcacagcaacacttccaaatggtattttattaacccctgtgatacagatgaagaaactgattgacagagaggttgaataatttacccaatggtacacattcaggaagaggtagagttagaatttcaaaccaagtcgtttgactccagggcctatgagttacgttcatagggctaatattcaaatgagagaaaagaagtaataaataaacatataatatgttgagtgggtgctacgaagaaaatatgaagtgtagttggagatgagttgtcaaaaaaaggtcttagcacttaaaaaacactgaaagcaaacaattctctttaccacctgaattgtaacagcaatctggaattgctataaagtacacaacatgggagaagtcttaaacaacagtttttattatttataggcccattgcacgctgtcattaaataccaatatgtacaatcaatcatgcattcattgatttaataaatactgtgcaaacaaaatagaaatacagagatgggtaagacaagtccttgggcctaaggactttataacctggtatttcacccaactacatgatagcataaataatgtttgcttctgtttaagtattccttgaacattatagatctaccaaagaaaattaaatacaaacctctttttaaagtgaatttgaaaagcaaaataaattggaatatatacataaatatgctaaaatttgtcatatgtactttgtgggctttgcatgtgttatttcattctcagggcaatctaagacgattacttttactgtctcattttacagagaagaaagctgtgcattaaagaaatcaaatacctttcccagggtcacacagctagtagcagagcctggatttgaatctgggttctgatttttaactgccatgacaatgatcaaagctcaaagtatgatctctgtgttagagttatcagggttgctcgctaaaaaagccgattctcaaacctcatcccagacctactgacccagacactgcaagtagaatccatcaaaatgcagtagttactctgagaatcatgaaactctactacaccgtctgtcttcctattcatggaaaccctctcctagtatataaatgtgaagaatatttctatttcaaacctgtattgataattctctggaagatcattttcctgggaacatattattgatgagactgcaaaacagaagtaaggtattggattgattttttcactgaagctagggaaatattgatgttcattggttccagagaagttcaatgatttccaatctgaattaactcctttaacaaatttttttttttttttttttttttttttttttttttttgagagtgaatgtccctctgggcttctaggccacatagttgcttagagaaattaggtactttgttgcacttgaaaacattaaaatctttctgactactttcactgagcaaagagacctaaaatgctttaaatttgcaacctttcagaaaataaattctagtgattatttatgactcaatctttcagattttgacagtgaaagtggaaggttgtccaaaacaccctaagggaattatttcacgtagagatgtggaaaaatttctttcgaagaaaaggagatttccaaagaactacatgtcacagtattttaagctcctagaaaaattccagattgctttgccaataggagaagaatatttgctggttccaagcaggtaaaaaaaaccttaaaaaataattactacatggaaattcactatctattcttttaattgtcaaagtaactgtagtctataatagatgtattaaataaataaataaatatattttgcttccagtgtaaacttcctgctgacatatttattttggaatgaaacattgcatctgacactttaaagatatagtaaaacttattttatatatatagttactagttgacttatcactgtttaaattatttaagaaaggtaaatattagagataagtgtgtgtgtgtgtatgtgtgggtgtgtgcatccctgtttatgtacgtgtgtgttcttagacaacactgagagagtttattaagcaagttctgagaagatagtgagttttcaacagaattttaaaagcatttatgacatcatagtggatgcctaagttttagcctatactttggctgtcctactgctttataagcaagtgggaaatgttataaagtaatatgatgttgaaatgtgcaaattacattgatggatgcagccaattgtaaaaataaatatacactttttttctaggacatgtatttttcaggatttatgtaagattacatttgtctattcataactaattataataatttatgtattagtgcacagggattaccaaaaatatttcatgcatctatatctgagcatgcatttgaattgattaatgacctctgaatttttggggtaggaaaaacatgtgaaacaatgttacaaaaagactacagttgcttggagtggttaccttcattgattttaagcagtaaaatcatttgctcaacatttttgggtatgctgtgaggctgtataaccatagtgtccttttgcctttagtttgtctgaccacaggcctgtgatagagcttccccattgtgagaactctgaaattatcatccgactatatgaaatgccttattttccaatgggattttggtcgaggttaatcaatcgattacttgagatttcaccttacatgctttcagggagaggtgagtgtttaatgaagacttaatatttagagaaattagggagatggcatatgaaaagtaatatgccattttctcagagtttacttgtttggaaggcagctgaagaattagaaaataagctcataaaaccttggagtaggcaatgtaaagatacacaagcacatataacctcatccaatttgtcaggaagaaaactccttaggtgctcactcagctcttggccgtgattacattgtagggagtgtgattatctcttttctgttgcacagccactaagccatttacaaagaaaagagcaaatccagtgtttataatgctaactctttcttctaaaataaatagagacattttggtactgcaaagggaaaataccattttggggattaaaattagctttacacaggtgttacaggtttccaaaataaaccttatcttgattggaattaatcaacatataggtagttacattgcattaaaaagttcagaaagttttgggtttagcacaatcaatttctttttgaaaattatgaggattgatttgtgattctctttcgtcatcggttgagcctatttaaactgcttaacagcatcaacctgaaatggatcttaatctacaggggatttaactggttttattataaagttatggataaaatatttaatagatatggatgaggactcatatcgttaacaacccaatactttctttcaaaatgagtagatctgtattacaatcccttgtggtgtgtgcagtagattttttccctttaatttaggaagcagttaataaacagctccatttggatccatttaaatttcttttagaacgagcacttcgcccaaacagaatgtattggcgacaaggcatctacttaaattggtctcctgaagcttattgtctggtaggatctgaagtcttagacaatcacccagagagtttcttaaaaattacagttccttcttgtagaaaaggtaaggaaatcaatttaaatgcttcaattgtaacactaaagaaatctaaacttaaaaacatatatgtatataaacaaaaaacctttactttaaagctttgtgacagtatgaggtttagacaagacgttgagctctgttttcaatcatgtaggctgtattcttttgggccaagttgtggaccacattgattctctcatggaggaatggtttcctgggttgctggagattgatatttgtggtgaaggagaaactctgttgaagaaatgggcattatatagttttaatgatggtgaagagcatcaaaaaatcttacttgatgacttgatgaagaaagcagaggaaggtgtgttttgaaacaacttacaaatgcgtttaagtgatccttcaatacttacaaaatgacttttattaaatgtaaatattcttattcataacggatgagttgaaaaatagtatattcaattatagggactgttcagaaaactggattatatttattatcaataaaatcttgtattctagattcagaaaatgtttttgagggtttgaatgctggctcattgaacaacatatcctcatctgtgaaacaggaataccaaccacatctatctcatagaattgttataaagattcaaatggacaatacatggatgtaatttactaacaggtctgccatataataacagcttcagcttcatgaatgtggcaaaagcagagaataaataactttctagtcagatgtctggtagtctgcagcagttcagaattctacaagtgaacgtaggaataaatttttgaaattccaagtagatagatattaagtgaatctttaaaatgttctcaaattttctagagaaatctaggattggttagaaagggaggggttagaaattatagaaaatattccattattttttcatatcaaaaccacagatttatgtatctccttaaatgttgtttttatttaaaaaatgttttattacttttcaggagatctcttagtaaatccagatcaaccaaggctcaccattccaatatctcagattgcccctgacttgattttggctgacctgcctagaaatattatgttgaataatgatgagctggaatttgaacaagctccagagtttctcctaggtaattctttttgttaatttgagaataaaaattaggatgtatttttctccttataatttagaaaatagatctcataattatattgtcatagatttttactgtcttcatatatttgttataatgttttttatttggaatgatatattttaaaggaatatcatgttacacatctggaatttgctttgcatataatcatgtagactaggatcaagatgaggatgagattatcatggaagcacaaatatttatgaaatatatctttgtatttgccttaattgccagggatgtgggaggcaaataagaaggttttcaggtgagttaagtgaagcagccatattttatatttaaaatgacagaataggtaaaggaagcacacctcagtgtagtcatagcaggggttttatgactgagtgtgacaatgctgaattctcatagaaatattcataaaaagccttgaaattaagaagtcagaagtgtcacatggtgatatactcaaattctttttttttttttttttttggtatgctgaacaatttacatttgttggttccatgaattcaatcagttattttcaatagaggatgatggaaatcattgaattcatgtagcatgtttaggtgttcattgagaaaaggtgaagtcatggtaaccatgttccaatattctcgtttgtatcttgacttcctggacctgtcctatcattgtacatggatttttaggcctaaaagatgtttttaaaaaatgctcatacacttcagaagatgaaaaatgtatgcattataactactttgggaaagaagcagtcaacataagatatgtcactgtatgtcattcagtagattacatgtgtggcttctcatgtctctcagaataaaagctaatgtctttacaaggcctgtgatgccatgatctatctgactcctcggttattgtttgtttgtttgtttttaatatattttatacaaatttatttttttaattgacaagtaaaaattgtatatatttatggtgtacaacatgatgttttgatatatgtatatgttgtggaatggagaagtttagctatttaacatatacattatctcaaatacatatttttgtggtgagaagttttaaaatctactctaatagcaatttacaagtatacagtatgttattattaacagtaggctgatgtactcaagttttaaacattccagagagtcattgaggcaactacgaaatgcattagactgatttaatgtaaagcatttaaagacaattttgaccttactttgtttagtttttgttgttgtttagtttaattttaatcaaattaccccagagataatgcctaaaatctatcagtcaggacataatattcttagcaaaaaactgtccaaaatttgggacatgatatttaaagctaaataaacacctttatacttttcatactggcattcattgggaagtttaggatgaatttaaatgctttggaactgaggaagttaatgtattagtaatagaggattaacacaaaatgctgaatcgtcaatgctgaatcctacattttaatcaaccccaaacttcaaggtatacaggaaagtaccagacatagtgcatccttcctctgaagaaatcccaaactgtcagacacagattcctaaaatatttctttgtcctgcattaaaatgtgtttcagatgaatggacacgttttgagtagtgtatgtggaaacgtcatttacaaagtccgtttagttggccgggcttagtagcttactcctgtaatcccagcactttgggagaccaaggcaggtggatcatgaagtcaggagttcaagaccaacctgaccaagatggtgaaacctcgtctctactaaaaatacaaaaaaaaattaggcgggtgtggtggcgggtgcctgtactctcagctgcttgggaggctgaggcagataattgcttgaacctgggaggtgaaggttgcggtgagccgagattgtgccactgcactccagcctaggcgacagagtgagactccgtctcaaaaaacaaaaacaaaaacaaaacagaaacaaataaacaaagtctgtttagttacacagataagaaaatgtttgtgattactctcccttctctagacctatgtcccataaatccataaatcccatgttcacttacagaaagcagtctagataggagtttctcagtctttgagctgttgccattttggctgggatgactgttatcgaggtgcatcgtaggatgtttggcagcatctctggcctctacccactagatgtcagtagtatctccccttcttccctcaggtgtgacaatcaaaatgtctccggatgttgccaaagataaggggcggggttgagtatccgtgatttaacaaattaggtgtatccttctaaaaacattttacaggtagagactccagcatctttatattagggtaatctggagaaggtcttgcctctctccgttttccctcttcccatttttattgtagggcagcagtgcattcaggctttttgaaaactctctttttcccagatagcagtaactattatgcagtgactaatacgacccaccttaatagatatgaatagacttgttttgtgaatatattttaaaatataaatgtatgggattttgttcatgcatctaagaagctacaaggtacatttcctcttggtggagctatttatttttctggagagccaagacaggtacttctacttctgtggtgtaatttgaggggttaggaaaatttccttgccttcaattttccttccaacctggatatcacaaatacacaatagtagtcctcaactttatttttgttctcagtcacctgaaagacatgacaatccatactctatattaatgcagcagtgattctcaaatagagaagggctttaaaaattagaaatccctactccatcttgaaattttgatgtatctccctagagtatgttacttctctatgctccattacaatttctctttattgttgatagctgtccagattgaggggaagcagagcaagatgcatctattatatgtttccatctctccgacccattctctccctttcccctctacttgctttctttctcttttccctcttctgtttacccgattctatttctgattccaatatataacagtttcccctgaaactctctcaataccaacaatcctaactaatggtttttaaaagtcaaatacttattaagtactggagggatagaatgagagaataccaagactgataagatgcaaataatacttttaacatatttacaatctagtagaaagacatgctcaaatgagttaattattttaatatactctgtctctgagcataaaatataattatatatgctcattatagatgtataaaaaataaacaaataggtagaagctttccatagatgtgtaatttcaccacttggaaattacaagttgttatagactgttttgcgtgtattcacttatatccatcaagtgactacatttcaaggcactacatgagaaccataaatattgtacaaacaggatttgctgaatgtcgttggagagtaacagtccatggggctgattgtgatcagtttctgaggcaggcctctatttctgggtatgtattggtccctgtaggcttgataaactccctggaggtggagatgatggagtagcagagctcatcaagggtatggaggcttgaaggtacaaagcatgctcaggaaattttggctattccggtttgtctagagcacttgttctcaaccttacctgctcgttactaattctactaaatatagaattaaaagaagaaaaaatctgataactattttctcctgggactaattagatcaaaatctttgaacccagacattagtgttttaaaaagctcctcagatgtattgttcagccaggactggggcagggaaagctactgaactcatcaagccttgagaatgagaagaacaagaagagaactttaaaaggatttaggggccacaatatgactatggagctgaatttagatttggtttcgtaggcaacatggaataatttgtgtgtgagcaggagaatgacacaatcaaagtggaatgataggaaaagtaattttacgagagagagagaatgagttggaagtaaggaactcaggaggcctcttgggactcagcagaaggctctgaggccaccaaatgggtgtggtggtagtggaaatggagaggaagagaatgtgaatgaggctgcacagtgaactgccagtgttagccgtggggttagaccggagcaagacttaaaatggttcgtcagttttaactccagaaagacctcaaaaagagcttttgtcttgttatcatcagctatatggaaggtagaataaaaacttgttaggagaaaagataataaatgtggcttttgataggctgtgattgagttggaagggcataccagtgaaatatccaacacaaagttagaagtgtagaagagcacttaggaggtggctataagtgaaaatgtgaaaattatctacgttagagggatagatgaagtcacagaagtggatgacataattgagcaggttatatgtagaggaaagatgggaaggttgaggacaaaatctttagatggatctttctcggagtagaaggaagaggaaatgttaaaggagatttgattcaatgaaacaagtagatcagatttctattcaaatatacaacagatataattaaaacagatataatttatttagttttttttttttttttttgcttggacagattaatttaagtgctttgtattttattttcaacaggtgatggcagttttggatcagtttatcgagcagcctatgaaggagaagaagtggctgtgaagatttttaataaacacacatcacttaggctgttaagacaagtaagaaattcagtaatataattatattaaattacacattattaatctgctggaattcttattttgcatacagttgtgaaaatgcaaaataatgaccacatttctacttgagtttaattatgcaattctagtttgtcttttctttgtagaatagaaagttttgtgttatttctcctgttgagaaacaaagcactatgttctgagaatccttataattgtgatgcatagtatgttgtaaaaacttttgtaagactcacttaccctcctctttttactttagaaccttactgttcaaaatgtgttccatggataagtagccaggcattatccaggagattgttagaaatgtagaaacttgggatttttcagcgccatgtttttgtccccggtgctccacagtagtcagactcctagctgcctccacttgcttccagaccttgaagcctagcaagctcctgacttcaccttctattttcttcagagtgtttatcttttacatttctggtctagggagagtatgatttttatttttattgaacatgacttccgtgtgttcagagtgaaagaagaagtttaatgcatgacctcacattgctaatttgattgaaggtgagaaatcttaaaccaaaactctcactgataagcttgcacctttcttttctggatttatccacttcaataagaaccgctattgattacttgctacaaagatggaaaagtcagcacgcttatcctatttcctacttcctgtccctgcccacttcctaaaatttaaaattggttaaattagttttcctcatgtataacaattataacttggaatgatttacaacacttttgattttttagtacaccaattctagacagcatggactgactccttgctatgtgagatgaggaaaattactgccattctttctcctcttcccatcaccttctcacgttccctaatttgttctattatttttatgtagtgaaagtttatcacgtctatattctgttctgtgctcataattaaattgttcacattttgtctatagtttggttctgaggacaaaaccaataaatgccatttatatatatttttatttgtacagaaccaaaatatttctacttttagacaaagaaatgcaaccttctgtcactaacttcttttcctaatagaatagtaacagtccaaataacaaagtcaaacggatcctctattgttatgtatttatcatcagtctataaaaataagggcatattttaattcaggccacatttttaccctgatttaaaaaaaattgtttttagagatgcagtctcactaggttgaccaggctggtctggaactcctggcctcaagtgatcctcccaccttaaccttctgagtaccagtggtgatttattttatgtagctttttgaggttttctgattttatatatatatatattttaaaaaacatacttcaggaaaagatattttcatcatgtcttcaagtgtttctaagttcttaatcatacagtttgtataacagaatctactttcttcttgaagacattcatcattcagcacatgacttactgctctaaacaggagagatggatttctaggctgcttgcgcactgattaatctatgagttagtttccttgccctctttgattattctcaatgtttcttggattccatgccttctcttggttgaattgtccttagtttttgttgaagaatatctttgaataattttttttaagaaaaggtgtttgtaaggtaaatgttttcagtccttacatgttaaaaatatcttaattttgcctcccatgtggtggatatgttatcacactttatattttaggaatctaggtttgaaataatttttcttcaaaatttgaagaaaattccgctgatttttagtgcccactgttgctaatgagaagtctgcagtcagtcatgtttgctcctatctaagctacctttaatttcattttaaaaactgaaaatttgatcttttgaatttcatttgttttcattgttctgaaccttcacaagtatatgtttgtgtgtaggttgtttttcattccatctaattcatttttttgtgaaaaattatcttctgtgtattctcttctattatttattatttcctccctaacctttattaatcatttttattgacagctactatgtaccaggttaggtgataggatacataatatacatatagtactaagctaaacccagtcaagcctctccttctctggagcctatatctagttacttatgattcattattgcttgccattgctccaagagtatgtattagatgacaagccttctgggtctatctcatccatgtttgagttccctcttcaagttttatctataatttgtgttacttacttgactatctcttgcaggtttctagtttgtttttcagaattgcctcatctattatttagttttctgctgaattttgttttgataatcatatctttcacttccagcaattctttccatcgcctctccttgttcttttgtagccatatttttggatgaaataccctcaagtgtttctgttcacatcaattggaatttaattttttgtattacttgcattattgctgttttctctgaggtcatttgctctatgggttcaccttgatttttctcttttatattgttggttttccaaattgagtagttttggatgacttcatatctatgaagtgagtactatattgattatcaaagataactagaatgggcattcttcacatttatgtaggtttgcttgttcaagttaccactttctgaacaagaaggtagaccatagacttttaagggctgtgtactgcttagggatactctgtttttaggttacatgggcagggatcaccaggactgctgagaccatacctagcaaaggaaggcaggctaacgatagttgatgagctaaaaaaaaaaaaaaagaaaaaaagtaaacaaaaaaatctcataatgttttaagaaagtttatgaatttgtgttgggccacattcaaaggcatcctgggccacatgtggcctgcgggccacgagttggacaagcttgttgtagatacttcagactctgttctacatctcttcatagatcgataacttgctgcaatgagcttatcagagaaattatcttcttttcatccataaaaaaagtcatgggaggtactcactataggattggtttattccagtgactctggccaattttctttaaaattcctttaaccttgttatattggtttaatttcttcagaatgacttttcccattgtggtaaactggttctaggcttcacaattacttattccaagtacaggagaaaagagggcacctcttttgaggacttgcatttcaaaggaatcaaatggcctacataacaacccattaaataaataaatgtctctcagcaccagttgagtcacctgtgcttttctcaacaagcactatgttcagggcaatgctctgtgctaattggctttaggtctctgttaccgaactgatcactgtggccctgagggtgctattacttagaatattctcaccttttctgagaggctgatgttggggtcagttccacctgaactaaagtccatgggctgcatgggtaaaggttgagtacctcagcaaatatcatggaaaggaaggggaatatacactgttagttaacagtggttactcctgtactctctcttgtttggatactactgggtatttatttctttttctgagtctttattgacattaggaatgagagatagaaatagggtgagagaggaagtaaaatcaatgctaatttttccatcttataccagaactcaactgtatttctggaatctatgtatccttacttttcctttgatttattacaaaaaaattcttagtggctacactaaaaattttgtaacctttaaaaaatacatagttacactacttcagttactctgagtaatagaaaatttcatgtgtgtacaaaatatcctgggggcattttaattattagtaactacagtcacagtgtagttctagaaccaaattaaacattttgcatatagaagcttatctgtgaaacaaatctggcacaatctcttttaatgtgtaggtaatttgttatataaattgattttttagctttgtttgttacttgtcagcatgcatttcaaattttacacaatgtgtttggggaactctgatggaagtcagtgcattaaaaatgtctacagggccaattagtgtataggcagggaggcaaactaagggaatggtggaagaaattggaaaaaaaaaaaaataaccgatgtgcataatgtactacttctcgtaaaaaaaaagaaaaaaagacaacaacataaagaaataaaaatgacatttgatggtcattctgccagtagtcatggggcagatctatgttacactgtactattatgctcttttttccttgcaatcagtgagttgcttttccaggatagaaaatttggattaggcctctgtctgtgcctgtgaaaataagtagagctaacttaactcgttctcatcagttttaaccaactgagctaatcagacatgggcattaaaaaaagattttatctactaagcaaatatgatcacagtctgaaactttgttcttggaaaatcccctctcagggtgttcagcctttcttcttcagtttgcagaattctccacgtttcagtttcctgataaatcagtgggtgctgctactccacgtctttgaagctggttgttaagaagcagcacttctacagcgatcacagtttaaagcatgaatcaatttaacatcacataagctataaatttcaacggagttacagtttcagagtaaagtgcaatatacagtataaagtgaatctggaattcaagcccaacaatgtcataaaagaggctgtgaagtctcacatgatgtgggccacagagaggattgttgccattcagatcttagctcaaatactaccacatctcttggagtggcccgccaggggccacccttactaagccaatccctctgttcaagccaaaatgatatctcagactttttttgaattgcagagagattgttgcagccagggattgcattagtaagggtggcccatggtgggccactccgaaggatgtagtaatatttgagctaagatctgaatgccaagaagacttcagccatgtgaagggtggagggatttctggggagaggggtcagcacaggcgaagaccctctgacgggaagaagctgagcacagcttgggattgaatgaatgccagtgtggctgaagggtggtgaatgaaggggaggggaaaaggagaaggtctgggaggcctgggcatgatcagatcaggcggtgaggccatggaggtagatgggattttcatctaagaaaaataagaagtcttcagagagttttcaggaggggatgatatatatttctttgaagttgagcgttatcctcggtaaattttgtagtcattaaaccagagattatagacagattttccctcatatgccagttgcagctgattagtagtggctatagagaatactgggctgagaaggattctgtggctaaccagaattcagtagacgagtttgacatggcccattagtatgactgtactgtgtgcactgtttctgcattaaatgtctgacaaaagcagagccaaaggaaaaatagaacttaacaatttaattctgacaatacagttgacccttgaaatacataaaggttggggtgctgaccccttgtgcagtcaaaaatttgcatataacttttgacctccccaaaatctgaaccactgatagcccgctgttgactggaagctttgctgataacacaaacacttgattaacacatgttttggatgttatctgtattatatactccattcttaccataaagcaagctagagaaaagaatattttatttaaaaaatcataaggaagagaaatatatttactcttcattaagtagaagtgtgttattataaaggtcttcatcctcatcatcttcacattgagtgggctgaggcgggggacatagaggaaaggtgggtcttggtgtctcaagagtggcagaggtggaagaaaatttatgtatatgtggactcagacacttcaaacctatgttgtccaagggtcaactgtagtttcaaaaccagctttttatttctgaaaatatgtttaaaaaactcagagaagaaatggaaagtttgctatgatccagtcatccagagaaatccatggtcaccctgttgatgcactttaaagaaggagaaacgtgggtaagacctgatggtgaattactcttatatgattttggacttttgcaggagctggtggtgctttgccacctccaccaccccagtttgatatctttgctggcagctggtattcgtccccggatgttggtgatggagttagcctccaagggttccttggatcgcctgcttcagcaggacaaagccagcctcactagaaccctacagcacaggattgcactccatgtggctgatggtttgaggtaagcaggtcttgttgtttaatattcagtgcatgacaagtgtgaccccagacttactctcaggttccgagaacacttcccagtaacaccgtgccccagtaacaatttacaaacaatttggatgaaaactaccatttccctgatcaaatttggttaatttcagaaaataagagtatgaaaaccatgtagaacctcatagcaagtagtaatagactttgaacccacaagttcagctgtggaacccataattttaaccctgtactgatctgccttctgtacaaatgtataagttaggcttcacagtatcaaattgagtgtcaattacatgattccagtgaggaaagatgagtccatacttctcaaggggactagagtgattcacgttggattcttcggtatgaccatctcacatgtctcagaggtacacctatccacgcagccagagcaagctttggagagggagcacactggagtggaaagcctgttgtctttgaaggcaaaacgcctgggattaatcactgttccacacacttagtaactgtgattttatatctctgattcccattttttaaatagtgtgtgaaccatgacttatatttaatgcataaaattgtgatgacctctgtaataatggaagacattccagatgaaactcttgatgtccgctctgccattgctccccaaccccagtcacctctttacacctgagagtcacctttcattcttttctttctctctcatctcatagctaatcctttagcaaatctttcagctctgccagcaaaatatatcttaatgcttctaacaatttctctcactaatgtctgagccagtatcatctctcattgcctttcggtcccctgcttctatctctgtctcatgatacatcccgttcttcacacagctactggggtgatttttctaacatgaaagttggatcaggccttgttcctgttatcaaccctcccctgccttatttcttgggcagggtgctcagccactcctatccctgaggttccttgcagataccagaggctttatattggctattgatttcactcaggagtgtctgactcccagatatgttctctacttattataaaggattatttgaatcctttcattcaggactctcagcacagaggatgtccccgacgaccctttgtctctccagcctctataggagtattcctgcctaggattttttatgttttcattttttaaaaatttatttattgtctgtcttgccatcagaatctaagtaccattaaaggagggacttttcatcctattcaccattgtatctctagctcctaaaatagtaagccttcagaattattgtgttgacagtaggggaagagggagaaaggaggaaagaaggaaaacagtgcctggtgcatagtagcaaagcagtgtatgtaactttccttctcttctgaaatgctatgaatatgccttttaggtagtatccagaaatgtcccttcctgaaagggtccagaaactactgaaaactgtccagattatgaaatgaaacagggtgcagggatttgcatttgagttgatatttctgcttttgaacaccagggggaaccttgggttaaattaatgtaggtaaagtgcagcttagtctcctgtatttcaatgccctctttccttcatttaactaactctaggttcagtttttccctaattcttccacaaatccgcaaagtgtttatttataaagtgaagaattgctattttttttttttttttttgcttaacactgttcgaaacaccttgtctctaaaatgacttattctagttctgtgaaaccttactttaaacaacaaatccagcagtttctgatgaagtaaatgaaatgtcagcatatttaaaataatttgcctaatttgttcttagcttaatgccagaaaagatttctggattttgtatcacaaaaggctagtagatttcagtatctatcaatcttctaccagcactaagtaatttttaaaactcagcattaaggtttattttcccaagtatgttttagcacagaaaataaaatcatgctcctttggagtcccttgaacgctggagctgtttagagtgacatacaagaactttcttcactttacatgctctccctccatcttgcttttacctgttagcttacctctccaatccaatccacttcctttgaacgctttatcataattctataaaacttaagaaaatataatcacctgcattttctatatgtttctgtgtttcagtatcttcaaaatggaatgtactgccttggtacatcacccactataaatctattatttctgctatatcccacacttgccaggccaggatacttgttgcctcatccaggccaaacaccattcccaaaaagcaactatgcatttgtccaccaggtccttgactctattttacattatctttttagtcaattcatttacttttatgctgcttactgctgccttggttcagcatgtccagggaattatcagaatttcttttctaaaataaaaatcaatttatgcttgcaattccgtggcagttctcaattatctgcaaagtgcatccaaactcttggcatagcatcaaagctctttctgtatgcctcttgcttccctttacagcccctgccaccctactgcccacactgcattctagccatgatgacagtcttgaattttcagttatgctcatgtctctccgtcattgtatttgttattcctctctttccaccaagttgtctgcctagaaaactcatttttcttaagaatttcctcacatatcatctctactgtgaagctcaaatgtgtcatgaagtgttagcttctccaacttgtgtttcttgcacatgctctgtgtaagacattgtcttaggtgctaaagagagaaagctagatattatattgttcttgaggttgaaagcttacagtctagtgggagactcaactttgctgtctttacctcaatgtttttcttcctctgtgcttccctagcatgtggtagttacatatttctggaaccttgtttgaacacctgtttgaggactgtttgagcacaatccttctggattgtgacaccctcaagagagcagatatacaaagatggctttgtatactaaatgactggccctcatagatacctagtacatatttgtcaaatgaatgaatgcattctatttttggaataattctattcagaatgagataaagtttactttaagctatgaagaaagaagtttcttagcaactcttaaaataatcacaaagaatgactgtttaacttaatataaaccagtttgttttaataaaatatttgacaatagtcatggttacacaatgcataaattatgactaaattattgtcaggaaggaaagatctttacttattatttcaaaagctattttgctagtctattaaaagctattaaaactgcacttcttaagattaaattctataattgaacattttaactaaccaagatattatctctttcccactgacattatttcaaattaagcttaactattcctttttagcctttggaaagtattctgagtctgtgttctataaatatacttagagaggcatgtcttataaaggatttggatactgttcagtgatgtatgacttggctttagtttttctattcttaatctctcagcttttctcttcagcatggcaagagtacctaatggcctttcagtaagcccttagtaaatttttctttcaagcccattacttactgtgaaggtcaacttcattagtgtatttatcttatttttttcagcccaaaataggtatattgaaatgaatgggcctaatgtcaaatgtcccaactacatcctggaagagagagaatcttctgctgtattagttgatgcaattaaataatatgtactctccaggccatcatacaattcaaagttcagggtatcattgccgttctcttctaatccttccagaagtgattggtactaggtaatggagtaactattaattgatataatgtgagccaaaactaacagtcacgaataagcaaagaatttaaatttaactccattaagtcttgtgaaaaattattttcaacctaggttgtcacatagctgtgacatcacatcaaatgctgtagtcaatttgacatcatggggcagagaagacagagttggaaatcagaattttatagacatataatgtgataatagcattagtagctgagacacggtaagctcactgaccatgtttccagaatggataagacctggttgagatgaaaactttatgttttttttttatattaactagcttttactctttgcctgaaatgttcaactctagttgctcatgattgcgtgggttagtctccaaaaggatggaatttaatgttacccatcatcttttccaagacaatgttttattcattctaactcagcccaaaatactcttttttaaccttaatatctaacatgattaggtttatggtaaattatatactcaaacagaagaagagactaatagcaagcaaaagtcttatattttcatttgttttcatccaaaaagtagaaaatattttccaaacattgggaaacattttagtcagaaaaataaatatcaatggtaaataggatagagaaaaattttaaatctgagctaaacctctatatggttttaagaaaatcaaaactattaaataaatggcaagtacaacaaaatcccatcaattcttatttaacttatttgaaatagctaaaatattcacatgatcattgagggtattcagaattgcctttaagtaattgttcatatatactaaagaaaagtctccaaaaattcggtctttgcctgagatagatttgtcttaaaattgaaatcattcgcttatcagatttgaccgttttttaaagcgtaactttactttgtaatattagacttgtatgttttgattttcttctataataccacttaactttaagggtcaaagtgagcacagaatttttgatgcttggcataatggacatgtatatttaaggaaattaggagagaaattattataatgtaatcacatttgaataagatttcctgtgcattttctggcagatacctccattcagccatgattatataccgagacttgaagccccacaatgtgctgcttttcacactgtatcccaatgctgccatcattgcaaagattgctgactacggcattgctcagtactgctgtagaatggggataaaaacgtcagagggcacaccaggtaggtgatcaggtttgtctcataattctgtcttcaggatggataaccactgacctcagatgtgagttcagaagagtcaaaaggaaaccagagtctatcacattgcgaacagaggtttactgtgtgaaaaattgcaagcattacattgtgatttttatcattgtattttgtaggaaaaaagacaattgaggtaatttttcagggcaaaaactgaataaaaaagaagagaacatttgatatcaagttatatttttataagttagatttttagattctttagatactctagaggttgtaaaaagtaacagcaaaaacttcagtctaggtactgttgacacttgtgaggcaaatcaaattcaggtccacagattctttttcataactctgaaatccacaaattctttttcataactctgaaaaccccaagttttttttttttaataactaatttggtgtcaaaacctaagcaaactgacttgatgcttattacagtctttatttctcatgcccagtgtgaatatgcgtacattttgctgcagaaatatatacatgtttgagtacagggggccggccctgacccttgaaagggtttctgtgcacatcactaactaccccatggaatattccctccctttctcagttcccactccacttcttcaactcaaattcatcagaatttcaagctcagattcctaaaaagcagttatggggccagtgatctgtacagacatgttgtctcagacatcagtttgagcaggaaatacaacatttaggggttggcatttgtttggagggggggatcactctatctttagggaaactttatatagttagttatttgtaagtaaaattacaggtggctatacgtcatcttgatgattgcaactcaattaaatcaccatgcctgacacagaagaaaatatgctagaggatatctcactagggaaaaggttccagttcaattcttgcccactcaacttttgtatttagataaacaaatggctccagattccaatgcctggttttatttttgctccaaatacatatatactcttttgttttgcataggtacattttagaagtagactgtgtattctcataaacacttcaaagtgtatgttctggctgagagtgtctttgtgtagttcaatgaaattaattataatttttttcagtaccgtgctgtgcgtcaggcccagtgccaggtatattagagacaagatctcttatcctcatgccagggctgaaagttagctattattttctcatttgccaaatgagaaaactgaggctcagggagattatataacttgcagaatatcactcagtaattggccgagataagaattcggtctgaatgagaaccagatccagagatatttggctttaaattctatagtctcttctaaaccatatgtgactctaacatgaagaagcttatttaattttccctattaaaaaagtcaaaacaaaacaatagagccatgaatagcaaatattgtcaatgagaggtttggaaaaacaatcttaaaagatgaaattccatagacctcatatattcctacctgaaaaaagtgggcacaggacaatgattttcttttggaagatctgctcatttttgtcatgggacatgaaggtggactggaccactcagtttcttctttctgcatctcccaacccagtctttctgttcatggggtgaaaatctgttgttgaagccttgtctacttaattggacagtggaactctcgggtctctatgggctgtgttcttgtacttgggctctgcttctctgctctgtggtctgggtcagctagcagccactcagttcaccttggttcagactcatggcctttcattttcagtatctgatttctggttttgctcaatacctgtctaaaatgtaatacccatctgattcttcataccaagcgacacaattgctcctgatcccttttaatctccaatattgaatggtggtaacataaatatggagacagatcatgacagaaacccagggcctaatcttttgtgcccactcttctcacaggcttcttaatactttggaagcttttttttttttttttttttttttttttttttttttttcgggctgtaacctagattttccctttatcattactctattattgttagagcacttctaattatcttagccctaaactctgcctccaattttaaataacaataattctcactcctactaatactgctactagtactactgtcaccaaactttttcttccccaaagcagttctgtttgggaagaaaacagttccctctcatacaatttcagttatcttcttgtcttttctgtttcatgaatcttcctgttaatgttacatcttttaacatggaaacttctagagaaacaaaagacgatggatttgttaaactttttgggtgcagttttatacgaactcttaccgaagtgtgtgcattatgagtgtgggtccattacagctgtaataggagcagaaccttccagagcatgagcgatgtgctgggcttgtgcttagctctgtccatgagttgagcatctcaatccttaggaccctctgatatatgtgctattactatttctagtctatagatgcagagactaaagtttagagagtatcaaaaacatttacaaggtcctataggacaaaactgtaagacaaaatgcatacccaagcagcttgagagcagagctcctgtccagcactgtgatagctggggacgcagaaacggaaacaatgcaattattgacaagggccgtggtgccatgtctgtccatattttgaaaataattatggtatggatattttcacctttaaataacttggagagtttcaacattaactcagtcaaatggatatatttatatcatatctggttgggagtgacagttaattctgggtcctgtggcaattgcacttttaactgagatgaatgctgactgatggctttaacatttaactaatgtgatattatttaacacacccacataaatactacagtctttgggtaaataaaatgttactggctggacatacacgaatatctgatggagattatggaacatactctactcatatttctctgaaagtaaaaaataaagtatatgtttcagtacacaatgtgatatatactcagacttaattcataaatttctcttattcttcatctatggatcctttatttatttacttattgcatttgttaaaatacaagcttctctgaaaaattatttctaaaaatagtttttagacaatcatattttctcaagtattttaacattatgatcattatgataattctccaaggggaaattatacttattttttattcatttattcattcatttggcaacaatatattgaacatttaccaagcaccaaactggctctaccgcttaatagtggcatgacgttcatcaggaaattgttagtgcaatcaagaacactagagattcactgggagaatttaaattagcttttagaaggatattatattagaattgaggcacttgatgaatctataaataatactatgttttcatgctagagatcgtgccaatgaagatatttactttgaaaaggggaagatgagaagtttaaaagcatttccatattgaagtaaatattcatttccatatcttcacagttatcttctcagagttctctgactcattgtgaaaaaaaattccaaccttctgcacagctctacgatcttcagattgttgcctagaggggtaaaatctattctaaaaggaggtgtgcactggatgagaatttagaattagatgaaataacccctagagtcttttcctgctttaagagcctgtgattccaaattctaacagtgcatttatcaagaaaaaaatatgctgaacattttagtagtttttgaatagtacctggataaaatagatacctaataaatgtgctcaatgaataataaataactgattaagatttaaataaacctcccaaatctctttcacattctaagatgggaagcataaaggttgttaatgaactagtgactgcgtgggtagctcattatttttaagtactcttgactttgctgttcattatctgtgtggccttaggaaaatacatatatttctgaaaggattatgtcatttgtaaaatagaaagtccttatctgtctaccacagatgattcttgtgcatatcaaaagaaatattcaataaggcatctgtaaaatagtagagagagatgaattaggggctattgtgattcgtttacattatgtcacaggtgcactttattagggatatgttttagagctgtcttaattacgtaattctttaacttagattgtgagaatgatattatggttatataggaaaatacccttattctaaggaaatgtatatttatgtctgaaacattgtatctgtaacttaatatagtatataaattatgctaatttacatgataattatatgtaattatattactatgttactatgtatacaatctatttacatgcatgtatgtgggggaatgttatcctcggttagtgtagtaggagttatcatgctcaaattcaatatctccacccttccaactcttcatgcttttctagcatggtgaggactgctgaactccatcttttgctggtagtctctctgtcaaatagaactgtttccaaattcagtcatttactccttgaaggctatgaattcatactttgttatatttttctggctgcatatttaaattactcttacaatcatataagttcattgtaaaaattttcgaaataaaaaggaagataaaatgtacagataattttagcaaatgaaataataattctattgggatgttttcttcttagattttaattatgtacattcccatcaactttttattttgaaaatgtttaagcctacagaacagttgaaagaacagtacaggccaagtgcagtggctcctgcctgtaatcccagcactttgggaggctgaggtgggtggatcacttgaggtcaggagttcaagaccagcctggccaacatggtgaaactccgtgtctactaaaaatacaaaaattagctgggcatggtggtgggcacctgtaatccctgctactcgggaggctgaggcaggtgaatcgcttgaaaccaggaggcggaggttgcagagagccgagatcacaccactgcactccagcctgggcaagagaatgagatctccatctcaaaaaaaaaaaaaaaaaaaaaaaagaaagaatagtgcagtatacactcatataccctacacataaattcattgattatttactttttgccctacttgttctttcttgctctgtttgcatatgaatgaatcgctgaaattaagttgtagacatcatgccatgtaatctctgaacagtgtgtgtgtatttctttagaataaggatgtttaatccagtctgtcactgagggacatttggattgattccaagtctttgctattgtgaatagtgccgcaataaacatacgtgtgcatatgtctttatagcagcatgatttataatcctttgtgtatatacccatacaccatggaatactatgcagccataaaaagggatgagtttgtgtcctttgtagggacatggatgcagctggaaaccatcattctcagcaaactatcgcaagaacagaaaaccaaacactgcatgttctcactcataggtgggaactgaacaatgagatcacttggactcgggaaggggaacatcacacaccggggcctatcacggggagtggggcggagggagggatagcattgagagttatacctgatgtaaatgacgaattgatgggtgctgacgagttgatgggtgcagcacgccaacatggcacaggtatacatatgtaacaaacctgcacgttatccacatgtaccctagaacttaaagtataataataataaaaaaaaagaataaggatgtttacttacatgatcataataccattatcacagctaagaaaataattcagttgattttttccacatatttgataactttctgtctatccaggattctatcctacattttcttttaatttatgtcatagcatatcatcttagaaagtgatccttaagttactgcatggtatacattgtttaattgtttaaccatttccctttgtgattggatttctttaggttgtttatatttttattattatcacaaatgttgaaatcactctttttttctgaagaatttaaaagtaatttatctctcttgtggaataaaagatttatttccccttaaaagaatttcaggcatgaacccaagagagaaggcattttttgttttagttgttgttgttatttttattttttattttttgggtagaaggagcaaagtgacaagttcaggaaataatgagagtgttagaattttggtcaggttaaagtgagttggagtgaagtttagaaatctttctgctcatctctcctgtttttaaaacactgtcctggaaatagttaatattaggaatgagaaaaatgatataggttttcctagtaagctttatttcttaattatgaaatactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgaattagtctgtctgacgagacacattttattacctaaaaacgtaattgttgactgcatggttgctacacatcacaacagcaggaatgcaagcatttggctgggctgtgggcacaccaacagaggacagctctcatttcttgacttaaatactgaaggatacacttctgaggtaaatccaatgctctttaaatcttttgtaatttaaagcatataccagttagaaagttacttagggataattttttaaatttattttgtacaaagtaaaaatttacaaattttacttttacaaagtaaaaacaaaagtataaatgttttacaaagaaaataagagccaatgtaggaatattattcaattagccttctgttagaacaagagtattcagggggacggagcaagatggccgaataggaacagttccagtgtccagctcccagcgcgagtgacacagaagaccggtgatttctgcattttcaacggaggtactgggttcatctcactagggagtgccggacaatcggtgctggtcagctgctgcagcccgaccagcgagtgctgaagcagggcgaggcatcgcctcacctgggaagctcaagggggaagggaatcccttttcctagtcaggggaactgagacacacaacacctggaaaatcgggtaactcccaccccaatactgcgctttaccaagggtcttagcaaacgggcacaccaggagattatatcccatacctggacgggagggtcccatgctcacggagcctccctcattgctagcacagcagtctgcaatctaacggcggctgggggaggggcacctgccattgctgaggcttaagtacgtaaacaaagccgctgggaagctcgaactggctagagctcacagcagctcagggagggctgcctgtctctgtagactccacctctggggacagggtacagcaaaacaacaacaacaacaacaacaaagcagcagaaacctctgcagacacaaacgactctgtctgacagctttgaagagagcagtggatctcccaacacggaggatgagatctgagaacggacagactgcctgctcaagtgggtccctgacccctgagtagcctaactgggagacatccccactaggggcagaccgacaccctacacctcacacggtggagtacacccctgagaggaagcttccaaagcaagaatcagatgggtacacacactgttcagcaatattctatcttctgcagcctctgctgctgatacccgggcaaacagggtctggagtggacctcaagcaatctccagcagacctacagctaagggtcctgactgttagaaggaaaactaacaaacaggaaggacacccacaccaaaacccaatcagtacgtcaccatcatcaaagaccagaggcagataaaaccacatggatggggaaaaagcagggcagaaaagctggaaattcaaaaaataagagcgcatctcccccggcaaaggaacgcagctcgtcaccagcaacagatcaaagctggatggagaatgactttgacgagttgagagaagaaggcttcagtcgatcaaacttctcagagctaaaggaagaactacgtacccagcgcaaagaaactaaaaatcttgaaaaaagagtggaagaactgataactagaatgattaatgcagagaaggccataaacgaactgacagagatgaaaaccatgacacgagaaatacgtgacaaatgcacaagcttcagtaaccaattcaaccaactggaagaaagagtatcagcgattgaggatcaaatgaatgaaatgaagtgagaagagaaatctaaagaaaaaagaagaaaaagaaatgaacaaagcctgcaagaagtatgggattatgtaaaaagaccaagtctacgtctgattggggtgcctgaaagtgagggggaaaatggaaccaagttggaaaacactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagttgtaggttggtgtctgtaatggggcaggatgatttccaggaggcattaagattatataccccatatatttctctggtttaagttagtattggaaaaaaagtattagaaaaatgtgaagcctgtttttggaacctgaaatatcagctccactggcagtttcggagttgaaattatttgaatatggtcaaagaaaaatttcaatggatgggattgggccaggaagactttattcaagcctgtcacaacaggggagagagatctgattgaactaaactccactgaaataaaaggtgggagaattttaagtgcaggggtgagctaatggaaaagtacctgaggatgtgttgtggggaagtgggagcagttgtcaatgtgattaggccatctgtgcttgctaattgtcccttcttgaaggtaggctcctattctcctacagacactagagaatagtcgtccttccttccttccttccttccttccttccttctttccttccttcctttttttttgaatgagttttgctcttgttgcccaagttgtagtgcaatggcaggatctcggctcactgcaacttccacctcctgagttcaagcgattctgtagcctcagcctcccgagtagatgggattacaggcatacaacaccaaacccagcaaattttttgtgtttttagtagaaatggggtttcaccgtgtcagccagactggtctcgaactcctgacctcaggggatctgcccacctcggcctcccaaactgctgggattacaggtgtgagccaccgcaccaggcctctttcttgataattacatttcaaaggaatggctcccaagtccttggaaaagacattcctggggtataaaactggaaagagtctgggaaaaggggcagagaaagaatttataattgcaagtcttctaaagtaaatactctaagaaaagggaggttaggagtttatagttgagaagtctatctaaagtttaataaagcggaggagaacattaaggccattttagccaatgtacatgttctttttgtaacaatttcaacatttttccttttagcaaacaaaaaaattttcttttggttggaaccgctgatggcaatttagcaatttttgaagataaaactgttaaggtaaatgttgaatgcattctacatctaaatttattttaagtcttttgttttatatatatctcactgccctcttatgggattataaactccctgagagcaagaatcataaattatgcttatatttgtattgcttcataaagtcttgcacacagtagatcctctgaaaatacttgctgattgactgtatattttatatgaatgaactaagaataagatgataaatgacatctgattgataatgttaggaatggaaataattcaatttgtacagatttgtatctgaggcagataagataattccttataaatatattgtgggaaaaaaaaccaaaaagatacttaagttttaaatatgacttgccattaactttttcttaagcattgaagaaatcatttaattttgtgttcttcagattcttatttagtcattaaagcatttattcctctatccatctattcatctttggttccatctattcactctacttcctacccgttcattctcctattaccaaaaagcttattatctgaggagagacatggaagtagactataataacccttaggttatttcttatgtaatttttacatggggaaaaagaatagattgaatgtaacaataatattttgaatatgacttaaattttttaatatatagtatttgtacatatttatggggtacatgtgatatgctgttacatgcatagaatgtctaatggtcaactcagggtgtttaggatatccatcaccatgagcatttatttctatgtgttgagaacatttcaagtcttctcttctagttattttgaaatgtttttaactgtagtcactttattgtactattgaacattagaacttattcctcctatctaactctgtgtttgtacccattaaccagcctctcttcatcctccccttctcccacacacccatatccttccaagcctctgataactatcattctactctctacctccatgagatcaacttttttagctcccacatatgagtgagtacacgtgatatttgtctttctgtgcttggcttatttcacttaacataatgacctccagttccatccatgttgctgtatatgacatgatttctttcctttttatggtcaaatggtattccattatgtaaacacacacattttctttatgcattcattcattcatgggcacttaggttgattccattttttagctattgtgaatagtgctgcaataaacatgggtatataggaatctctttgatatactggttccctttcctttagattagtatcagtagtgacattgttggattgtatggtagttctatttgtagttttttggagaaatcaccgttctgttttccgtagtggctatagtaatttacatacccaccaacagcatatgggcattccgttttttccacatccttgccagcatgttattttttgtcttttttacaatagtcattctaaccgggtgaagaagatctcagtgtggttttcatttgcatttttactgatgattagttaatgttgagcattttttttcatatatccattggccattactatgtcttcttttggaaatgtttatttagatcctttgcaaacgttttgttttgttttaagacagggtctcgctctctcacccaggctggagcacagtggcatgatcatagctcactgcagccttgaccttctgcactcaagtgatcctctaacatcagcttcacgagtagctggcactacaggcatgtgccaccatacctggctatttatttttattttttgtggagatgggaccccactatgttgtccagactgatctcaaactcctgggctcaagcaatcctcctgcctcatcttctcaaagtgctgggattacaggcatgagccaccgcaccctgctctttgtctacttttcaatggggttctttttttttttttttttttctgttgagttgctttttcgagtttcttgtgtatcctggatgaatagtttgcaaatatttcctcccattcaacagatcgtctctatattgttgatagtttcctttgctgtgcagaagctttttagtttattattgtcccatttgtctatttttgtttttgttgcctgtgcttttgggatcttaaccataaactctttgtctagatcaacgttctgaaatgtttcccctgtttccttctaacagtttcatagcttctggtcttacatttaagtctttaatccatcttgagttgatttttgtaaatagtgagagagtggggtctagtttcatccttctgcagactgatatccagcttttccagcacaattttttgaaggtagttttctttctctcatgtatgcttttggtgcctttgttgaaaatcagttggctctaaatatgtgggtttatttctgggtcctctacattggtctatgtatctgtgtttttgccaacactgtgctgttttggttactctagccttgtaatatattttcaagtcaggtagtgtgatgcctccagctttgttctttttgctcaggattgttttggctattttggctcttttttggttttataatttttttttctatttctgtgagaaatatctttggagctttcatgggaatttcattgagtctgtagattgctttgggtagtatggtcattttaacaatattaattcttccagtctgtgagcatgaatatctttccatgtgtttgtgtcctcttcaatttctttcatgtttttcaggtttccttatagagattgttcatcatcttggttaaatttattcctaggtgttttattaattttttgtagctactttaaatgggattgctttcttgatttttcagccactttgttcttgtgtagatatgctactaatttctgtatgttggttttgaatcctttattgtccttatttatcagaactaagggttttttttttgatggaatctttaggtttttgagttttaattttaatatctctaatcatttaagatggaaagtcgttttttgaaagcacagatttttagtgttttattctgtggatactcaatttgctgagtgtgttttatttttttttttttgacaaagcttgaaggagctgctcctttgaagatactaaatataggaaatgtcagtactccattgatgtgtttgagtgaatccacaaattcaacagaaagaaatgtaatgtggggaggatgtggcacaaagattttctccttttctaatgatttcaccattcagaaactcattgagacaagaacaagccaactgtaagttattttttatctgtacaagtaatttgtcattatctttatgtttattccttataatcattaataatactgttgataattcataaggaagatcttttaaagtgcataatttatttctatcataaaattaaacattcattataaaaaattttaaaaatttcaaaaagcagaagggtatttttaaaaagtcactcagcctaatatatagtaatatatagcctaatatatagcctaaacatacttttagggataaaatatgtaaacccattgtaatcttagtagtatttatcaatctaaatttttaaataatttttattatctgtgtttcaaattagacatgaaattggaagacaatcaactctgcattttaccaaattcatagactttacatatgcaatttgggtaatttccattaagtattgattgtaggaaagatagacagcaagtattcttgcttgtctcaagttgtttctagatttgataattatacagatgtctactaacaaccaagttagtgataccagtttcaaacaagagtaaaataaaatattaatataaacctctttcaagtttgtttttttcagttgtattttaatcaaatctttgccattggtccttatttatcacattcctcagtgataagcagtgtaggattgtggataagagcataaaccatagttcacgtatcgctttgccatctattggttttgtgaacttgggcaataacctttcacatcttcagtcatctcttacctgaggattgtaatattctctatctcaaagggatatttggaggagtaaataagaacattaatatatggaacttaattaacataacgaccagcacctggtaagctgtcaataaacattagctattgttgttattattattattagctttgagtcacaaatccctaccttagagaatatcctagtttcccaatatccatctaattgcccaagattggcacttgggagtaatctttgactcctttgtttttgctccctttatccacttgaccctcctaattgtcattcgaatctttgtacttctcactgttctcagtgctgctaccataggccagactgccatccatcatctgtggccacattaacaagagcatccagttctcatcctctgattacactctcttccacctattttcagcgttgcagacagagggacctttctaaaatgtacatcaatctgatgcaattctcctgcttaaaacccttcggtggcatcccattgtcctttatatgaagtccagattccttaagatagcctactgggcccttcataattcagtgcttgcttagctgtctagattcatattttgcaaccttcttgtcatctgtgctttacccaaactgaaattgactcagatctctaagataacctgttacctttcacccccagcctttgaatgtagtattctctttacctggataactattatgcaccctgcctatttcagtccaaatgccacttgctctgagtggcaggttaggtaactttgtgcttccattgcatctattgttttccatcacaatagccattttatttttataattgtattttttaaagtagtttcttaataccactaaatctactagttttcaacattggctgtgcaattagaaaccactaggtagctgaaaataatgatacctgggccctacctcagaccaattaaattagatcagttaagcctgggatggggatcagacttgtttttttttcaggttctcaagtgattctaaagtatattcgaggttaagatatactgcagactgcaatgtattgtaagttcccatgaatgaggatttttatttctgtgtgtacatatttgtttactagtatgtggttaacatttagatcaactcattttcattctgtaacacccactttttaaaaaatgaacgtaaaaatgtattttattatttttatctttcaaattttattttagactccaagggtacatgtgcaggtttgttaacaaaggtatagtgagtgatgctgaagtttggaatacaactcaactcacaacccagcaagtgagcatagtactcgataggtagtttttcatcctttttccccttcctgtaatttccacttttaacctaattatacaagcctgaaaacctttaaaaagaaagggcctccagtttatttttttatttcgtaagacattttatgggctcatggatatcaattaagtccttaaagttccatataagatttggagcacagatgctttactagagagcatccataaagatcaagctctcaaagatgttcatctcccaaaagagattgggacttagttgcataaacacttagagagaaatatttgctctcttctgaacaagtatctcctgtggccttgatctctaccccacgaaacagacatcacatcacgaatcagaggttgcctcattatcagtaccctcatcatcatcaatacacaccgactgagaggcatattgagtaatgaaagatgactgcctttgaagccagaagactgcacaacttgtggagttctaggtctgcaacatgtttttagtcctaggtcagcaagcatgacgtcagtagtcatggaaccctgagcaaattatttagcatttgtacatgtttctttctacaattaaaaacattgagatttgtcatattttatgtttttttaattaagggtcaaacaagatagcacacaaaagtattttataaaatacgaaaattccctgcaaaactttatcctaattggaactattttctattaaatacagcaaacatccaggaaggcgttacctaaaacatagtggctctctgacaacacatcatatttttatctccttttccagaatagaaagaaaagggggagaaaaaaaaatcttcctgctctaggatgtactaatgattgttgaatcattatggtattttcatgttatctatctgatttaaatgcaattttgactatttttacttattcctggttgttcattcatactggagtgccgtctatcccccacttcatagactgcttggtatatcagaggtgcttatctgtgcaactctttactggacgagggttatgtagaaaatacatcgtcctcatccttacgaaattacactcataatctagtgtgagggatgccctaataaagacaattttatatttaataaggtctataatatgacagtgacaccagtggggaaaagggactggttagtctattttgataggtcagggaagaaatccagaggagctgacatttaagttaatcctcaaaggccgagtaggagtttgccgtgttgatgtggcccatggtagccaatctgtttgtgaaatatgtacaatgtcagatgccttaggttgaaagggaaatattttaaggtgtttgtaatttttctttatgtttaaaaggggaaaatggcaaatattttactttctgtttatgtttgaatgatgtggatttttgtttcctataatttgactggctcaactgcaaagatataccttgctttaaaatttgaagacactgcaactaaattttttttcaacattttatattttataactctagatgtaaaaggctaatgcttagttttctgagcattcatgaaacaaagttttgcaacgacattcaaaagttacagatattataatatttccttcagaaatttagatatagtataaaattctacaaagagctacatagaattgaaactaaaagtaagtccaaagtcaacattggacataatctttattttattatcaagagaaattagtataaagtaaccaaaagtatgtaaaataccaaagcatgttatatattcaattcagaattgttagggaagaatatgaaataattgcaatagtctagcttgtttagttttcaaaatagtgtttttacatgcattaagaactaaggttgtattacacgtagaaattttaagaagaaaacaaatagtgatgactttctatttttttttctctgtaggttttcttacgcagctttcagtgattccaacatcgtaacagtggtggtagacactgttctctatattgctaagaaaaatagccctgttgtggaagtgtgggataagaaaactgaaaaactctgcgaactaatagactgtgtgcactttttaaggttaattcattggcttttaagtttatttccaaaagaattatctttgcacttcatgtgtcgcagaggaaggatttgtcttcctttctgcctctgaatagagaattttttaaaaaagcagaaaaaaaattgtaatgcttctcagcaccagctcttcaaatcaggaacattttgtcttgggaaaataaaaaaataggagcataatatgcatagttttttcacggtattataaagaatgctctcgaatgaaaatagtatattattgaaaatgagcatactggagtctctgctagctttgatgtagttgtgtcacagtgtcaaatatactatttataattaaattgtgggccccaagattatctgctcaaagaaaaagagtcacaaaataatagacgaatatggggggaaacacaatggactcagcaaggcactaactaaggagttgggatcaagacctcagaatgagagcatagtgcttagtctgatgcagccagtgagtgacaaatccatagcaagcacattctttctgtgctggtgctaagaaacaggaccattttcaagcttatttgctagctactttatatttttattttattttggttttaccttatagatctatgatactcttaagaacatttgagattacacactgtatctgtaaaaggagacttcaaagtttcctttcttagattcatctgacagtttttctctcgattgtgagaagggctcacagtttatgttcagaagaaccaacaggtctccttgataaaggattccttacttcctggagtaccaaaacgattaggattcttttatttctggacacttcattttggtcgtgaattagactattcactggttctgggaaaaaatccagtggtttgtatggatatctcttacatgtgaatgactataattttacgttcctttgtaacactgagacatcatgtaaagcttttgagtctaacttttttttctttatcctgggcacatgcatgctatttttactgaattagatagctttggtatttataaaaattgtatccctcttattcataatttcctgaaaatgaagggctattgttgtctttgataatttatgcttcaagtaaagaaatgtggctctttggcattctgtgtttagcaaaatttgctttgtataattttaatgatgcataatgtgtggtgtcatgttttcataatttaaaatgttatttatgttttcatatataaatagcatttatgtcttagctggtggtaaaattattaatgtatactttatggttctagggaggtaatggtaaaagtaaacaaggaatcaaaacacaaaatgtcttattctgggagagtgaaagctctctgccttcagaagaacactgctctttggataggaactggaggaggccatattttactcctggatctttcaactcgtcgagttatacgtataatttacaacttttgtgattcggtcagagtcatgatgacagcacagctaggcaagtttctttcctttagatatttttcatattctctaagtcttataaaatatgcctttattttacatttactttttctctgcactttccagtgtcatttggatggtcttggaggttcacacaatgaaacataagactggtgtaaattgtgaatagggtcattacagaaatggtgggagtaaatgctctcagtcccataagagaagcagattactgcagctgaacactcagtttgggtcttacttgcttttttcctttttacctaaggcaaaaatgggaaatacatagtgttgaatatatttcactttttgagcaaagaaaataaagaaaatgtttattttaatcatagtatagcctcccacgcttgttaaagaatctcatttagtttttcattctataacaaatctttattcttgcagcaatacatgccgaaccacacaacctacaaatattgacaaatcatgttttactgaaactttgtctttttttgcttctatttttctatttaaatatgatgaaatcgtgatagcacataaaatatattttctgcataaatatatttgtgtcttcctttgataataatttgatttagaaaataacaataaaagcacatatacaaaagtttacaaaaacaacactatggggtttaattccgaaaaaaactagaatttatgtaactttagcaaataattaatgaatgttttgaacgtggtgaagaaaatagattcattacaagtatgtgtgaaagaggaacatgtgtttctctaacaccttcacctatttttcatttatagacgttagagttgcacagaaggagttagaattagatgctcttaatgactgtgaactattaagatacatgtccacacaagcagaacagtaggtatctcaatgggttgtctccgtagtcttattctaccaaagttgttgcattctctagttgaattgtatgtactttgggacccggatagcttgcttataactgaagttatagtggaatttcaatgggttacagtttgattttaaaataaagatcaatttgaacatagcctacaaggtgctgcgtgagctggcttcactgtacctctcctgcctccatcatctaccacattcctaccagatcttcctcgtctagatgaacatccagttcttcttaattactgtgctatattttgcctcagagatttgcacatgctgtttatttctttgcttaaagtaggttttttatgcttagttaactcatacgctttgaaatgttagctcctgtgtcaaaacctctgagaagcaaacactgattaggtcaaagttcccactttgggttcccataacagctttcttgcatagttgtgatcatagtcatatatattttttttcattaatactagtctcttcactagaatataaacaccaagcaggttgggttagtgtgttttggtttacccctttattcccaggatctagcctaggacttacatagaagacttttgatgcaaatttgttgaataaattagtgaatgatttgagaagaaaatatgatattttgacatcagtatatccatccatctaagtgtccatctaaatactcatatttgtaccttaccatatccaaagaacttttcacacacattacctcatttaacattgtaactttggggagggtaatgtataaatactaagcctattttatagaaaggttaagctgttttctcagactcacataattaagagttgcagcaaggagtggatcacagattctgttacttttttttaatgctggcctttattcaatataatttaagggtcacctagaaaatagaactgtgaattcagttccaaggtatttgtgtcttagactatgaacaactttaatttttttcagaccagcttaatatatagttttaacggaaaacttccatattttgtttttgtaaagggagccttaaaaatgtcatgctggtattgggctataaccggaaaagtactgaaggtacacaacagcagaaaggtaacatttaaaaggatactgtattccaaacagtgcaatgacatgaatgatagtaacatattatgtgttttataaatttgtagaaaatattacatatggtataatcaggaattttaattggtagtttatagtataaagaacttaggcataaactttcaaaattacaagtgatatgaagtgttaaatatttatattttcagatgaagtagaggtgtcaatcactagctcaaccttaaactaaatgtgaatattttttacaacttacctgtatctacataatgtttaattttcaacagtgtttgaaaagctttatttcttttagattatgaaatgttaatttattaaatgtccacactcttcttgaaatttagtagtttctataatgtattataaaaattgtccaagtacagttttttataaataattatttagtgcattagttatagctgtgtttatatatacatttatctaagtcaactaaaaatacataagccaaactgaaataaaataagaatgttttatggtggatctttgaaacttgatttcatttttttctttttctagagatacaatcttgcttgactgtttgggacatcaatcttccacatgaagtgcaaaatttagaaaaacacattgaagtgagaaaagaattagctgaaaaaatgagaggaacatctattgaataagagagaaacaggaattgtctttggataggaaaattattctcttgtaaatatttatttaaaaatgttcacatgaaaagggtactcacattttttgaaatagctcatgtgtatatgaaggaatgttatatttttaatttaaatatatgtaaaaatacttaccagtaaacatatattttaaagaactatttaaaacacaatgttgtatttcttatgaataccagttacttttgtgcattaattaatgaaaataaatctgtgaaatacctaatttaagtactcatactaaaatttataaggccgataattttttgttttcttgtctgtaatgaagataaactttattttaaattctatgcttaagacaagactattgcttgttgatttttctagaaatccgcaaggtagaatgaaaatattaagacagtttcccgtgtaatgtattccctcttagattgctttgaaatgcactatcatatatgcttgcaaatattcaaatgaatttgcactaataaattcctttgttggtatgtgaattctctttgttgctgttgcagacagtgcatgttacacaacttcactcaatccaaaagaaaactccattaaaagtactaatgaaaaaacatgacatactgtcaaagtcctcatatctaggatatgaggagagtttctgtgtctttctgtgtctttcctagacatgatagagttgtctctatcttttcaactctatctttgagtatggataccctgaattttgtataattagtgtaaatacagtgttcagtccttcaagtgatatttttatttttttattcataccattagctacttgttttctaatctgcttcatcctaatgcttatattcatcttttccctaaatttgtgatgctgcagatcctacatcattcagatagaaacttttttttttcagaattatagaattccacagctcctaccaagaccatgaggacaaatatctaacacttttcagttgctgaaggagaaaagagctttagttatgatggataaaaatatctgccaccctaggcttccaaattatacttaaattgtttacatagcttaccacagtaggagtatcagggccaaatacctatgtaataatttgaggtcatttctgctttaggaaaagtacttttggtaaattctttggccctgaccagtattcattatttcagacaattccctgtgataggacaactagtctatttaatattctcagaacttaatggcatttgactatatgaaaactttaaatttatttatattcagggtgatcaaattcttaaacatgaaagattttctgtattttaacttgctacgtaattaacgacaacaaaaaaaaatacagtagagctctttgttccagtgttatctctttcattgtcactttgtatgtatttgcaaatttttttaccaaagacaaacacaaaaatagaatactgtatttacatggaataataaaatttttaaaagcatgtttatgaatttttaaactttgtgatagtgttttgcttttcacatacaggtctgttatccacctcaaaggaaactttgtatattaatttgtatatggaacattccacgataagaaagtgcaactaaagttttttcttgagaacttacagaatatttaaatttacttttctataatacgtatggttgccaggatcccaggacaaaatctgatgggtatgaaacattctattttcaagttctcttaaaaatgttttgtgagtaaatttgtttgctcttgagtactgaaacaaaatataagactttagagcaaatgatatatacaaaaaataggcacagtcacttcaagtgttttctgattagaagcctaaaataacctgctaattatgatcaaaatacaaacattatcataacagaaaatattcttttgggaaaattttgaattcaaaaaagggcgcctctctgactctaattcactctatcgattatgtgtgaactattttaactaaaatgcaacttatttttcatcaaggcagtgaaatatattgatgaaacatagcagaaatgttctaatattgaggggagataaaattcaaaaccgttgggactttgcttctttatccatcactttgagtagcttaacacctaacctggtaaattgaatgtttttcatggaggctcatcagcaattcagtaaaatagtaaactatgtcaactcgggagaaactgacatcctcgttctccatgctagccagttgctgatccagggtatcattgtttctaataacaattcagaatctggctgcttaaaggcacctaggtacttggttctttctaatttgtcaaggaatttggagtgatcctatcaccctgatttcaagcaagagacagtcacctgacccaaaggcctgctgtctgaacacactctgagtgagtgagcagagatgtggtggttctctctatgtgctgccgccacactgctcttgatttctacccttacctgggaagtctctacttgatgtctgtctcaggctaagaaaaagagaagagaaagggaatgagtattagcatctggatcatggggctgcttcttggcctctatgagaatccactgtttcacagcaatcacggcctacaaaactggatgttatagagtaaacaagaggtatcattctgacctgggcttcgccacatttacccactgaacactcccaagagaaggttgttaccatttatttatgaaaataccaaactccgatacatactctattagaagtattatggaaaagtagagcatatgtctacctggccagagaatagaggatcctgatcacaaaaaaagtacaaatatttaaacagggacttaggacaaacgggcattcaacaatttccagagtgaaataacattctaggcagatgatgacacatgtgctgtcttaggaacttgagcttattttgaaagcatccctatcaaatacatgctgaaatttgtgacaagttcccattccttacagtacttacgggatacacttaagtgactgaagatgcaagagaagtatatatttgtgtatggatatagcacttttatcattaattgggagattataaagttaatgagctgttctttgcagagggagtatttgttaggatgaaatggggagagatgtttcaaacaccaagtttattttataggttaagaaatcctagaaggaatccatgactttatgtatatgtacaatatatga

SEQ ID NO: 4-10 - skipped (7 entries)

SEQ ID NO: 11 - DNA, 22 bp, synthetic construct
  source 1..22: mol_type = other DNA
ttccacacttgcggtctttaga

SEQ ID NO: 12 - DNA, 20 bp, synthetic construct
  source 1..20: mol_type = other DNA
gcgggacctggtaggtactg

SEQ ID NO: 13 - DNA, 15 bp, synthetic construct
  source 1..15: mol_type = other DNA
atgagcagcaatgat

SEQ ID NO: 14 - DNA, 25 bp, synthetic construct
  source 1..25: mol_type = other DNA
catcactcaggctgttaagacaaga

SEQ ID NO: 15 - DNA, 22 bp, synthetic construct
  source 1..22: mol_type = other DNA
cagctgccagcaaagatatcaa

SEQ ID NO: 16 - DNA, 22 bp, synthetic construct
  source 1..22: mol_type = other DNA
ctttgccacctccaccacccca

SEQ ID NO: 17 - DNA, 21 bp, synthetic construct
  source 1..21: mol_type = other DNA
gagcttcctcacgcagttcac

SEQ ID NO: 18 - DNA, 22 bp, synthetic construct
  source 1..22: mol_type = other DNA
tgctgggtcttgaaaatgaaga

SEQ ID NO: 19 - DNA, 21 bp, synthetic construct
  source 1..21: mol_type = other DNA
ttctaaatgaatcaggagtcc

SEQ ID NO: 20 - DNA, 23 bp, synthetic construct
  source 1..23: mol_type = other DNA
ccaggtacaatgcaaagcttaat

SEQ ID NO: 21 - DNA, 22 bp, synthetic construct
  source 1..22: mol_type = other DNA
tcagtccaatcactgacaagtt

SEQ ID NO: 22 - DNA, 24 bp, synthetic construct
  source 1..24: mol_type = other DNA
ttgggaagtccttggtgttcacca

SEQ ID NO: 23 - DNA, 19 bp, synthetic construct
  source 1..19: mol_type = other DNA
ggcgagttatccgcaccat

SEQ ID NO: 24 - DNA, 24 bp, synthetic construct
  source 1..24: mol_type = other DNA
ccaaaaccagcatgacattcttaa

SEQ ID NO: 25 - DNA, 23 bp, synthetic construct
  source 1..23: mol_type = other DNA
tgagagccatggccacagcacaa

SEQ ID NO: 26-29 - skipped (4 entries)

SEQ ID NO: 30 - DNA, 20 bp, synthetic construct
  source 1..20: mol_type = other DNA
attaatttgcacagaagtga

SEQ ID NO: 31 - DNA, 20 bp, synthetic construct
  source 1..20: mol_type = other DNA
gacttctattaatttgcaca

SEQ ID NO: 32 - DNA, 20 bp, synthetic construct
  source 1..20: mol_type = other DNA
accaaggacttcccaatcat

SEQ ID NO: 33 - DNA, 20 bp, synthetic construct
  source 1..20: mol_type = other DNA
gtgcatggcatcaaaaatta

SEQ ID NO: 34 - DNA, 20 bp, synthetic construct
  source 1..20: mol_type = other DNA
tccacatttctgaatcccag

SEQ ID NO: 35 - DNA, 20 bp, synthetic construct
  source 1..20: mol_type = other DNA
tcttggtcatctggatacat

SEQ ID NO: 36 - DNA, 20 bp, synthetic construct
  source 1..20: mol_type = other DNA
cactgaatttcttggtcatc

SEQ ID NO: 37 - DNA, 20 bp, synthetic construct
  source 1..20: mol_type = other DNA
cccagacactgaatttcttg

SEQ ID NO: 38 - DNA, 20 bp, synthetic construct
  source 1..20: mol_type = other DNA
gaggaatctctttcagttta

SEQ ID NO: 39 - DNA, 20 bp, synthetic construct
  source 1..20: mol_type = other DNA
aaccttatgatgtctttggc

SEQ ID NO: 40 - DNA, 20 bp, synthetic construct
  source 1..20: mol_type = other DNA
gaaacatccaaatgtgtgcc

SEQ ID NO: 41 - DNA, 20 bp, synthetic construct
  source 1..20: mol_type = other DNA
tgcttctcatcagaaacatc

SEQ ID NO: 42 - DNA, 20 bp, synthetic construct
  source 1..20: mol_type = other DNA
tcctcggtggcattcacaaa

SEQ ID NO: 43 - DNA, 20 bp, synthetic construct
  source 1..20: mol_type = other DNA
ccacttgggttccacaaagt

SEQ ID NO: 44 - DNA, 20 bp, synthetic construct
  source 1..20: mol_type = other DNA
tacaaagccacttgggttcc

SEQ ID NO: 45 - DNA, 20 bp, synthetic construct
  source 1..20: mol_type = other DNA
ggaaaccattcttccatgag

SEQ ID NO: 46 - DNA, 20 bp, synthetic construct
  source 1..20: mol_type = other DNA
tttctaggcaggtcagccaa

SEQ ID NO: 47 - DNA, 20 bp, synthetic construct
  source 1..20: mol_type = other DNA
agcaggcgatccaaggaacc

SEQ ID NO: 48 - DNA, 20 bp, synthetic construct
  source 1..20: mol_type = other DNA
caatgatggcagcattggga

SEQ ID NO: 49 - DNA, 20 bp, synthetic construct
  source 1..20: mol_type = other DNA
tgttggttataaatgacatt

SEQ ID NO: 50 - DNA, 20 bp, synthetic construct
  source 1..20: mol_type = other DNA
tgaggattttctttcaaaca

SEQ ID NO: 51 - DNA, 20 bp, synthetic construct
  source 1..20: mol_type = other DNA
ttcaaaatgtcaaagacctg

SEQ ID NO: 52 - DNA, 20 bp, synthetic construct
  source 1..20: mol_type = other DNA
aagtgacagaatcagtcatc

SEQ ID NO: 53 - DNA, 20 bp, synthetic construct
  source 1..20: mol_type = other DNA
tgagtttctgaatggtgaaa

SEQ ID NO: 54 - DNA, 20 bp, synthetic construct
  source 1..20: mol_type = other DNA
gctgccactagccatggtgg

SEQ ID NO: 55 - DNA, 20 bp, synthetic construct
  source 1..20: mol_type = other DNA
tcctggacattgttcagcct

SEQ ID NO: 56 - DNA, 20 bp, synthetic construct
  source 1..20: mol_type = other DNA
tggacagacttctattaatt

SEQ ID NO: 57 - DNA, 20 bp, synthetic construct
  source 1..20: mol_type = other DNA
agttccaagttgtaactgac

SEQ ID NO: 58 - DNA, 20 bp, synthetic construct
  source 1..20: mol_type = other DNA
agagccaaggcttcatggca

SEQ ID NO: 59 - DNA, 20 bp, synthetic construct
  source 1..20: mol_type = other DNA
tttatgatggttttccgaag

SEQ ID NO: 60 - DNA, 20 bp, synthetic construct
  source 1..20: mol_type = other DNA
tgatctcggatcttgaaatt

SEQ ID NO: 61 - DNA, 20 bp, synthetic construct
  source 1..20: mol_type = other DNA
atgaatactggtcagggcca

SEQ ID NO: 62 - DNA, 20 bp, synthetic construct
  source 1..20: mol_type = other DNA
aaactgatttcagttcccca

SEQ ID NO: 63 - DNA, 20 bp, synthetic construct
  source 1..20: mol_type = other DNA
accttggtcatctggataca

SEQ ID NO: 64 - DNA, 20 bp, synthetic construct
  source 1..20: mol_type = other DNA
tgatctcggatctatgaaat

SEQ ID NO: 65 - DNA, 20 bp, synthetic construct
  source 1..20: mol_type = other DNA
cccctggtgttcaaaagcag

SEQ ID NO: 66 - DNA, 20 bp, synthetic construct
  source 1..20: mol_type = other DNA
tgtcaaagacctgagaaagt

SEQ ID NO: 67 - DNA, 20 bp, synthetic construct
  source 1..20: mol_type = other DNA
cagcctgactatcaacttct

SEQ ID NO: 68 - DNA, 20 bp, synthetic construct
  source 1..20: mol_type = other DNA
ggacttcccaatcatttcca

SEQ ID NO: 69 - DNA, 20 bp, synthetic construct
  source 1..20: mol_type = other DNA
gaaaatagtctcagtgagga

SEQ ID NO: 70 - DNA, 20 bp, synthetic construct
  source 1..20: mol_type = other DNA
ttaagaaaatagtctcagtg

SEQ ID NO: 71 - DNA, 20 bp, synthetic construct
  source 1..20: mol_type = other DNA
ccatgatgctgttattctga

SEQ ID NO: 72 - DNA, 20 bp, synthetic construct
  source 1..20: mol_type = other DNA
cattcaaccatgatgctgtt

SEQ ID NO: 73 - DNA, 20 bp, synthetic construct
  source 1..20: mol_type = other DNA
gctctctttctcacatacct

SEQ ID NO: 74 - DNA, 20 bp, synthetic construct
  source 1..20: mol_type = other DNA
ggactgctctctttctcaca

SEQ ID NO: 75 - DNA, 20 bp, synthetic construct
  source 1..20: mol_type = other DNA
aatcctccaaggcaaatgct

SEQ ID NO: 76 - DNA, 20 bp, synthetic construct
  source 1..20: mol_type = other DNA
aaaggaccaagccaagaagg

SEQ ID NO: 77 - DNA, 20 bp, synthetic construct
  source 1..20: mol_type = other DNA
tggaaataaaggaccaagcc

SEQ ID NO: 78 - DNA, 20 bp, synthetic construct
  source 1..20: mol_type = other DNA
acactgtccatagaagagtc

SEQ ID NO: 79 - DNA, 20 bp, synthetic construct
  source 1..20: mol_type = other DNA
caaacacactgtccatagaa

SEQ ID NO: 80 - DNA, 20 bp, synthetic construct
  source 1..20: mol_type = other DNA
aaaatcttcagttccttcag

SEQ ID NO: 81 - DNA, 20 bp, synthetic construct
  source 1..20: mol_type = other DNA
agatgcagtttctctactct

SEQ ID NO: 82 - DNA, 20 bp, synthetic construct
  source 1..20: mol_type = other DNA
cctcacgacctgcaaaatcc

SEQ ID NO: 83 - DNA, 20 bp, synthetic construct
  source 1..20: mol_type = other DNA
gaattcctcacgacctgcaa

SEQ ID NO: 84 - DNA, 20 bp, synthetic construct
  source 1..20: mol_type = other DNA
tctcatcagaaacatccaaa

SEQ ID NO: 85 - DNA, 20 bp, synthetic construct
  source 1..20: mol_type = other DNA
ggtggcattcacaaagtggt

SEQ ID NO: 86 - DNA, 20 bp, synthetic construct
  source 1..20: mol_type = other DNA
gatcttgaaattaaggctct

SEQ ID NO: 87 - DNA, 20 bp, synthetic construct
  source 1..20: mol_type = other DNA
aatcttgaccaaaatcccat

SEQ ID NO: 88 - DNA, 20 bp, synthetic construct
  source 1..20: mol_type = other DNA
tcttcaacagagtttctcct

SEQ ID NO: 89 - DNA, 20 bp, synthetic construct
  source 1..20: mol_type = other DNA
gcccatttcttcaacagagt

SEQ ID NO: 90 - DNA, 20 bp, synthetic construct
  source 1..20: mol_type = other DNA
atgttcttcaccatcattaa

SEQ ID NO: 91 - DNA, 20 bp, synthetic construct
  source 1..20: mol_type = other DNA
tcaaattccaactcatcatt

SEQ ID NO: 92 - DNA, 20 bp, synthetic construct
  source 1..20: mol_type = other DNA
aaaatcttcacagccacttc

SEQ ID NO: 93 - DNA, 20 bp, synthetic construct
  source 1..20: mol_type = other DNA
attaaaaatcttcacagcca

SEQ ID NO: 94 - DNA, 20 bp, synthetic construct
  source 1..20: mol_type = other DNA
gaggctggctttgtcctgct

SEQ ID NO: 95 - DNA, 20 bp, synthetic construct
  source 1..20: mol_type = other DNA
ataatcatggctgagtggag

SEQ ID NO: 96 - DNA, 20 bp, synthetic construct
  source 1..20: mol_type = other DNA
gatggcagcattgggataca

SEQ ID NO: 97 - DNA, 20 bp, synthetic construct
  source 1..20: mol_type = other DNA
ccatattctttaactggatc

SEQ ID NO: 98 - DNA, 20 bp, synthetic construct
  source 1..20: mol_type = other DNA
tctcaaccataggccatggg

SEQ ID NO: 99 - DNA, 20 bp, synthetic construct
  source 1..20: mol_type = other DNA
ttcttgaggattttctttca

SEQ ID NO: 100 - DNA, 20 bp, synthetic construct
  source 1..20: mol_type = other DNA
atgtcaaagacctgggcaga

SEQ ID NO: 101 - DNA, 20 bp, synthetic construct
  source 1..20: mol_type = other DNA
gcaaccatgcattcaacaat

SEQ ID NO: 102 - DNA, 20 bp, synthetic construct
  source 1..20: mol_type = other DNA
tctactatcagcaacttcct

SEQ ID NO: 103 - DNA, 20 bp, synthetic construct
  source 1..20: mol_type = other DNA
aaacaagtgacagaatcagt

SEQ ID NO: 104 - DNA, 20 bp, synthetic construct
  source 1..20: mol_type = other DNA
gtgtttttctaaattttgca

SEQ ID NO: 105 - DNA, 20 bp, synthetic construct
  source 1..20: mol_type = other DNA
acttcaatgtgtttttctaa

SEQ ID NO: 106 - DNA, 20 bp, synthetic construct
  source 1..20: mol_type = other DNA
aaataacttggaggctggaa

SEQ ID NO: 107 - DNA, 20 bp, synthetic construct
  source 1..20: mol_type = other DNA
gacaaaactgatttcagttc

SEQ ID NO: 108 - DNA, 20 bp, synthetic construct
  source 1..20: mol_type = other DNA
cacttaccaagaaaattcat

SEQ ID NO: 109 - DNA, 20 bp, synthetic construct
  source 1..20: mol_type = other DNA
attatagaatttaatcttaa

SEQ ID NO: 110 - DNA, 20 bp, synthetic construct
  source 1..20: mol_type = other DNA
acctccctagaaccataaag

SEQ ID NO: 111 - DNA, 20 bp, synthetic construct
  source 1..20: mol_type = other DNA
tccgctgctcagggaaccgg

SEQ ID NO: 112 - DNA, 20 bp, synthetic construct
  source 1..20: mol_type = other DNA
tggtgaacaccaaggacttc

SEQ ID NO: 113 - DNA, 20 bp, synthetic construct
  source 1..20: mol_type = other DNA
gaatcaattggtgaacacca

SEQ ID NO: 114 - DNA, 20 bp, synthetic construct
  source 1..20: mol_type = other DNA
ggaggagatctaaggtcttc

SEQ ID NO: 115 - DNA, 20 bp, synthetic construct
  source 1..20: mol_type = other DNA
aggtgattttacctgaagtt

SEQ ID NO: 116 - DNA, 20 bp, synthetic construct
  source 1..20: mol_type = other DNA
atcattggctggaaatgagt

SEQ ID NO: 117 - DNA, 20 bp, synthetic construct
  source 1..20: mol_type = other DNA
ggaatgctttcatagcttcc

SEQ ID NO: 118 - DNA, 20 bp, synthetic construct
  source 1..20: mol_type = other DNA
ttgtaacaggcttccagcca

SEQ ID NO: 119 - DNA, 20 bp, synthetic construct
  source 1..20: mol_type = other DNA
ccctatgagctgggaaatgg

SEQ ID NO: 120 - DNA, 20 bp, synthetic construct
  source 1..20: mol_type = other DNA
ccagggaagtgttgcttcct

SEQ ID NO: 121 - DNA, 20 bp, synthetic construct
  source 1..20: mol_type = other DNA
tccagctgcactggtaatga

SEQ ID NO: 122 - DNA, 20 bp, synthetic construct
  source 1..20: mol_type = other DNA
caggatttccaatgaacctg

SEQ ID NO: 123 - DNA, 20 bp, synthetic construct
  source 1..20: mol_type = other DNA
tctgcagtgtgtgaagcact

SEQ ID NO: 124 - DNA, 20 bp, synthetic construct
  source 1..20: mol_type = other DNA
tgatgcaccagcagcttaga

SEQ ID NO: 125 - DNA, 20 bp, synthetic construct
  source 1..20: mol_type = other DNA
tttgcttgattggcatctgc

SEQ ID NO: 126 - DNA, 20 bp, synthetic construct
  source 1..20: mol_type = other DNA
gttccaccaatttgggactg

SEQ ID NO: 127 - DNA, 20 bp, synthetic construct
  source 1..20: mol_type = other DNA
atcttgttcacgagatccac

SEQ ID NO: 128 - DNA, 20 bp, synthetic construct
  source 1..20: mol_type = other DNA
ggcaaatgctattgttggcc

SEQ ID NO: 129 - DNA, 20 bp, synthetic construct
  source 1..20: mol_type = other DNA
gagtgcattctggtgaagct

SEQ ID NO: 130 - DNA, 20 bp, synthetic construct
  source 1..20: mol_type = other DNA
aactcttcagagtttcacat

SEQ ID NO: 131 - DNA, 20 bp, synthetic construct
  source 1..20: mol_type = other DNA
gggagcatatccctgatatt

SEQ ID NO: 132 - DNA, 20 bp, synthetic construct
  source 1..20: mol_type = other DNA
ctttaggacaagcctcaaga

SEQ ID NO: 133 - DNA, 20 bp, synthetic construct
  source 1..20: mol_type = other DNA
agaccgcaagtgtggaagat

SEQ ID NO: 134 - DNA, 20 bp, synthetic construct
  source 1..20: mol_type = other DNA
tctaaagaccgcaagtgtgg

SEQ ID NO: 135 - DNA, 20 bp, synthetic construct
  source 1..20: mol_type = other DNA
actgacatccagagatgtca

SEQ ID NO: 136 - DNA, 20 bp, synthetic construct
  source 1..20: mol_type = other DNA
aggatcttagttccaagttg

SEQ ID NO: 137 - DNA, 20 bp, synthetic construct
  source 1..20: mol_type = other DNA
gggaaaggatcttagttcca

SEQ ID NO: 138 - DNA, 20 bp, synthetic construct
  source 1..20: mol_type = other DNA
ccccatttcattgggaaagg

SEQ ID NO: 139 - DNA, 20 bp, synthetic construct
  source 1..20: mol_type = other DNA
ccaagatctgatttcttggt

SEQ ID NO: 140 - DNA, 20 bp, synthetic construct
  source 1..20: mol_type = other DNA
agcaaggtacaatgctcgct

SEQ ID NO: 141 - DNA, 20 bp, synthetic construct
  source 1..20: mol_type = other DNA
catggcatcaacttcagcct

SEQ ID NO: 142 - DNA, 20 bp, synthetic construct
  source 1..20: mol_type = other DNA
attgaagagccaaggcttca

SEQ ID NO: 143 - DNA, 20 bp, synthetic construct
  source 1..20: mol_type = other DNA
agcctttatattgaagagcc

SEQ ID NO: 144 - DNA, 20 bp, synthetic construct
  source 1..20: mol_type = other DNA
agcgcgagcctttatattga

SEQ ID NO: 145 - DNA, 20 bp, synthetic construct
  source 1..20: mol_type = other DNA
gaagaagcgcgagcctttat

SEQ ID NO: 146 - DNA, 20 bp, synthetic construct
  source 1..20: mol_type = other DNA
gcagggaaccctcgcttatt

SEQ ID NO: 147 - DNA, 20 bp, synthetic construct
  source 1..20: mol_type = other DNA
tagcagtctggaatcagctg

SEQ ID NO: 148 - DNA, 20 bp, synthetic construct
  source 1..20: mol_type = other DNA
cgtgaggaagctcattttca

SEQ ID NO: 149 - DNA, 20 bp, synthetic construct
  source 1..20: mol_type = other DNA
gttttggacaaccttccact

SEQ ID NO: 150 - DNA, 20 bp, synthetic construct
  source 1..20: mol_type = other DNA
tctggaatttttctaggagc

SEQ ID NO: 151 - DNA, 20 bp, synthetic construct
  source 1..20: mol_type = other DNA
tgcttggaaccagcaaatat

SEQ ID NO: 152 - DNA, 20 bp, synthetic construct
  source 1..20: mol_type = other DNA
gtggtccacaacttggccca

SEQ ID NO: 153 - DNA, 20 bp, synthetic construct
  source 1..20: mol_type = other DNA
tggagcttgttcaaattcca

SEQ ID NO: 154 - DNA, 20 bp, synthetic construct
  source 1..20: mol_type = other DNA
ggtggaggtggcaaagcacc

SEQ ID NO: 155 - DNA, 20 bp, synthetic construct
  source 1..20: mol_type = other DNA
ccaaggaacccttggaggct

SEQ ID NO: 156 - DNA, 20 bp, synthetic construct
  source 1..20: mol_type = other DNA
cctgctgaagcaggcgatcc

SEQ ID NO: 157 - DNA, 20 bp, synthetic construct
  source 1..20: mol_type = other DNA
tttgtcctgctgaagcaggc

SEQ ID NO: 158 - DNA, 20 bp, synthetic construct
  source 1..20: mol_type = other DNA
ggaggtatctcaaaccatca

SEQ ID NO: 159 - DNA, 20 bp, synthetic construct
  source 1..20: mol_type = other DNA
gcaatctttgcaatgatggc

SEQ ID NO: 160 - DNA, 20 bp, synthetic construct
  source 1..20: mol_type = other DNA
cgtagtcagcaatctttgca

SEQ ID NO: 161 - DNA, 20 bp, synthetic construct
  source 1..20: mol_type = other DNA
tgatgtgtagcaaccatgca

SEQ ID NO: 162 - DNA, 20 bp, synthetic construct
  source 1..20: mol_type = other DNA
tgttgtgatgtgtagcaacc

SEQ ID NO: 163 - DNA, 20 bp, synthetic construct
  source 1..20: mol_type = other DNA
agcccagccaaatgcttgca

SEQ ID NO: 164 - DNA, 20 bp, synthetic construct
  source 1..20: mol_type = other DNA
ggtgtgcccacagcccagcc

SEQ ID NO: 165 - DNA, 20 bp, synthetic construct
  source 1..20: mol_type = other DNA
tcagaagtgtatccttcagt

SEQ ID NO: 166 - DNA, 20 bp, synthetic construct
  source 1..20: mol_type = other DNA
gcagtgttcttctgaaggca

SEQ ID NO: 167 - DNA, 20 bp, synthetic construct
  source 1..20: mol_type = other DNA
tgtcatcatgactctgaccg

SEQ ID NO: 168 - DNA, 20 bp, synthetic construct
  source 1..20: mol_type = other DNA
aggactttgacagtatgtca

SEQ ID NO: 169 - DNA, 20 bp, synthetic construct
  source 1..20: mol_type = other DNA
tccttcagcaactgaaaagt

SEQ ID NO: 170 - DNA, 20 bp, synthetic construct
  source 1..20: mol_type = other DNA
tggaagcctagggtggcaga

SEQ ID NO: 171 - DNA, 20 bp, synthetic construct
  source 1..20: mol_type = other DNA
agttgtcctatcacagggaa

SEQ ID NO: 172 - DNA, 20 bp, synthetic construct
  source 1..20: mol_type = other DNA
atcagattcccctgaggtac

SEQ ID NO: 173 - DNA, 20 bp, synthetic construct
  source 1..20: mol_type = other DNA
cagtctgaatcagattcccc

SEQ ID NO: 174 - DNA, 20 bp, synthetic construct
  source 1..20: mol_type = other DNA
gttcagctgcagtaatctgc

SEQ ID NO: 175 - DNA, 20 bp, synthetic construct
  source 1..20: mol_type = other DNA
actgagtgttcagctgcagt

SEQ ID NO: 176 - DNA, 20 bp, synthetic construct
  source 1..20: mol_type = other DNA
cccaaactgagtgttcagct

SEQ ID NO: 177 - DNA, 20 bp, synthetic construct
  source 1..20: mol_type = other DNA
acttactggtgaacaccaag

SEQ ID NO: 178 - DNA, 20 bp, synthetic construct
  source 1..20: mol_type = other DNA
atgagctgggaaactttcaa

SEQ ID NO: 179 - DNA, 20 bp, synthetic construct
  source 1..20: mol_type = other DNA
tctggcatgcctaaatgcac

SEQ ID NO: 180 - DNA, 20 bp, synthetic construct
  source 1..20: mol_type = other DNA
ttgtactgaccttggtcatc

SEQ ID NO: 181 - DNA, 20 bp, synthetic construct
  source 1..20: mol_type = other DNA
tcttcagagtctgaaaagac

SEQ ID NO: 182 - DNA, 20 bp, synthetic construct
  source 1..20: mol_type = other DNA
aagcgcgagcctggagggaa

SEQ ID NO: 183 - DNA, 20 bp, synthetic construct
  source 1..20: mol_type = other DNA
tggaggtatctgccagaaaa

SEQ ID NO: 184 - DNA, 20 bp, synthetic construct
  source 1..20: mol_type = other DNA
atcacctacctggtgtgccc

SEQ ID NO: 185 - DNA, 20 bp, synthetic construct
  source 1..20: mol_type = other DNA
tgggactgctctctttctca

SEQ ID NO: 186 - DNA, 20 bp, synthetic construct
  source 1..20: mol_type = other DNA
atttgggactgctctctttc

SEQ ID NO: 187 - DNA, 20 bp, synthetic construct
  source 1..20: mol_type = other DNA
ttcacgagatccactattca

SEQ ID NO: 188 - DNA, 20 bp, synthetic construct
  source 1..20: mol_type = other DNA
gtcacctttcccaatgctta

SEQ ID NO: 189 - DNA, 20 bp, synthetic construct
  source 1..20: mol_type = other DNA
ggccacatccagggccagcc

SEQ ID NO: 190 - DNA, 20 bp, synthetic construct
  source 1..20: mol_type = other DNA
tcaacttttcctatacaaaa

SEQ ID NO: 191 - DNA, 20 bp, synthetic construct
  source 1..20: mol_type = other DNA
ataaaggaccaagccaagaa

SEQ ID NO: 192 - DNA, 20 bp, synthetic construct
  source 1..20: mol_type = other DNA
gaaataaaggaccaagccaa

SEQ ID NO: 193 - DNA, 20 bp, synthetic construct
  source 1..20: mol_type = other DNA
tctggaaataaaggaccaag

SEQ ID NO: 194 - DNA, 20 bp, synthetic construct
  source 1..20: mol_type = other DNA
ttatctggaaataaaggacc

SEQ ID NO: 195 - DNA, 20 bp, synthetic construct
  source 1..20: mol_type = other DNA
aattagaagtcttatctgga

SEQ ID NO: 196 - DNA, 20 bp, synthetic construct
  source 1..20: mol_type = other DNA
tcaccattcttgctagtgta

SEQ ID NO: 197 - DNA, 20 bp, synthetic construct
  source 1..20: mol_type = other DNA
cctgaggctgttccttcttc

SEQ ID NO: 198 - DNA, 20 bp, synthetic construct
  source 1..20: mol_type = other DNA
catcaaatttagacagcaca

SEQ ID NO: 199 - DNA, 20 bp, synthetic construct
  source 1..20: mol_type = other DNA
aacacactgtccatagaaga

SEQ ID NO: 200 - DNA, 20 bp, synthetic construct
  source 1..20: mol_type = other DNA
agcaaacacactgtccatag

SEQ ID NO: 201 - DNA, 20 bp, synthetic construct
  source 1..20: mol_type = other DNA
ttgagcaaacacactgtcca

SEQ ID NO: 202 - DNA, 20 bp, synthetic construct
  source 1..20: mol_type = other DNA
agaaatgagccttcacttcc

SEQ ID NO: 203 - DNA, 20 bp, synthetic construct
  source 1..20: mol_type = other DNA
ggtaaaattctcctacacta

SEQ ID NO: 204 - DNA, 20 bp, synthetic construct
  source 1..20: mol_type = other DNA
atgtctttgcaaatttggtg

SEQ ID NO: 205 - DNA, 20 bp, synthetic construct
  source 1..20: mol_type = other DNA
ttcagtaaatcttcatgatc

SEQ ID NO: 206 - DNA, 20 bp, synthetic construct
  source 1..20: mol_type = other DNA
atgacctgagtgaatcatct

SEQ ID NO: 207 - DNA, 20 bp, synthetic construct
  source 1..20: mol_type = other DNA
gagaagaaatgctgtctgaa

SEQ ID NO: 208 - DNA, 20 bp, synthetic construct
  source 1..20: mol_type = other DNA
tgctgaaaggtctagtgatg

SEQ ID NO: 209 - DNA, 20 bp, synthetic construct
  source 1..20: mol_type = other DNA
tatacagcatttctggctta

SEQ ID NO: 210 - DNA, 20 bp, synthetic construct
  source 1..20: mol_type = other DNA
ttctggtgaagctccagctt

SEQ ID NO: 211 - DNA, 20 bp, synthetic construct
  source 1..20: mol_type = other DNA
tcttcagagtttcacatagc

SEQ ID NO: 212 - DNA, 20 bp, synthetic construct
  source 1..20: mol_type = other DNA
aaggaaatgatgtaaattta

SEQ ID NO: 213 - DNA, 20 bp, synthetic construct
  source 1..20: mol_type = other DNA
agagacatcaagattagcaa

SEQ ID NO: 214 - DNA, 20 bp, synthetic construct
  source 1..20: mol_type = other DNA
ttcactgtaggatctaaaac

SEQ ID NO: 215 - DNA, 20 bp, synthetic construct
  source 1..20: mol_type = other DNA
gacagctggttatatgacag

SEQ ID NO: 216 - DNA, 20 bp, synthetic construct
  source 1..20: mol_type = other DNA
gctccagtttctctaccaca

SEQ ID NO: 217 - DNA, 20 bp, synthetic construct
  source 1..20: mol_type = other DNA
agttccttcagtctcaaggg

SEQ ID NO: 218 - DNA, 20 bp, synthetic construct
  source 1..20: mol_type = other DNA
ctgatagggatgaaatgtgg

SEQ ID NO: 219 - DNA, 20 bp, synthetic construct
  source 1..20: mol_type = other DNA
ggcactgaaactctccactt

SEQ ID NO: 220 - DNA, 20 bp, synthetic construct
  source 1..20: mol_type = other DNA
atagaaggaggcaagaaagg

SEQ ID NO: 221 - DNA, 20 bp, synthetic construct
  source 1..20: mol_type = other DNA
ctggaatacaggaaaatttg

SEQ ID NO: 222 - DNA, 20 bp, synthetic construct
  source 1..20: mol_type = other DNA
gctcatatctaaagaccgca

SEQ ID NO: 223 - DNA, 20 bp, synthetic construct
  source 1..20: mol_type = other DNA
gatttccagtgtgcgggacc

SEQ ID NO: 224 - DNA, 20 bp, synthetic construct
  source 1..20: mol_type = other DNA
tgctgatctgattatggcta

SEQ ID NO: 225 - DNA, 20 bp, synthetic construct
  source 1..20: mol_type = other DNA
ctctactctagaccataaat

SEQ ID NO: 226 - DNA, 20 bp, synthetic construct
  source 1..20: mol_type = other DNA
ctcaggaggaatctctttca

SEQ ID NO: 227 - DNA, 20 bp, synthetic construct
  source 1..20: mol_type = other DNA
ttgtaactgacatccagaga

SEQ ID NO: 228 - DNA, 20 bp, synthetic construct
  source 1..20: mol_type = other DNA
tgcttaatttccccatttca

SEQ ID NO: 229 - DNA, 20 bp, synthetic construct
  source 1..20: mol_type = other DNA
atcaaagttaagatgcagtt

SEQ ID NO: 230 - DNA, 20 bp, synthetic construct
  source 1..20: mol_type = other DNA
tatgatgtctttggctttac

SEQ ID NO: 231 - DNA, 20 bp, synthetic construct
  source 1..20: mol_type = other DNA
ccttatgatgtctttggctt

SEQ ID NO: 232 - DNA, 20 bp, synthetic construct
  source 1..20: mol_type = other DNA
gaaaccttatgatgtctttg

SEQ ID NO: 233 - DNA, 20 bp, synthetic construct
  source 1..20: mol_type = other DNA
agaaaccttatgatgtcttt

SEQ ID NO: 234 - DNA, 20 bp, synthetic construct
  source 1..20: mol_type = other DNA
gaagaaaccttatgatgtct

SEQ ID NO: 235 - DNA, 20 bp, synthetic construct
  source 1..20: mol_type = other DNA
gtttcattcggttataaggc

SEQ ID NO: 236 - DNA, 20 bp, synthetic construct
  source 1..20: mol_type = other DNA
caataaggtggttttaccac

SEQ ID NO: 237 - DNA, 20 bp, synthetic construct
  source 1..20: mol_type = other DNA
ctttgcattccaagatctga

SEQ ID NO: 238 - DNA, 20 bp, synthetic construct
  source 1..20: mol_type = other DNA
ttatttggataggccagtct

SEQ ID NO: 239 - DNA, 20 bp, synthetic construct
  source 1..20: mol_type = other DNA
aaaatcccacacatttagga

SEQ ID NO: 240 - DNA, 20 bp, synthetic construct
  source 1..20: mol_type = other DNA
aaggtacaatgctcgctgcg

SEQ ID NO: 241 - DNA, 20 bp, synthetic construct
  source 1..20: mol_type = other DNA
atggcatcaacttcagcctg

SEQ ID NO: 242 - DNA, 20 bp, synthetic construct
  source 1..20: mol_type = other DNA
gggaagaagaagcgcgagcc

SEQ ID NO: 243 - DNA, 20 bp, synthetic construct
  source 1..20: mol_type = other DNA
gcttctcatcagaaacatcc

SEQ ID NO: 244 - DNA, 20 bp, synthetic construct
  source 1..20: mol_type = other DNA
attcaggagttccttggtga

SEQ ID NO: 245 - DNA, 20 bp, synthetic construct
  source 1..20: mol_type = other DNA
gcattcacaaagtggtaatc

SEQ ID NO: 246 - DNA, 20 bp, synthetic construct
  source 1..20: mol_type = other DNA
tgatggttttccgaagtttt

SEQ ID NO: 247 - DNA, 20 bp, synthetic construct
  source 1..20: mol_type = other DNA
aacaacaagctgatctcgga

SEQ ID NO: 248 - DNA, 20 bp, synthetic construct
  source 1..20: mol_type = other DNA
atgattttttcaagttctac

SEQ ID NO: 249 - DNA, 20 bp, synthetic construct
  source 1..20: mol_type = other DNA
caattacgggaaattcaatt

SEQ ID NO: 250 - DNA, 20 bp, synthetic construct
  source 1..20: mol_type = other DNA
ctgcagctgattttctctca

SEQ ID NO: 251 - DNA, 20 bp, synthetic construct
  source 1..20: mol_type = other DNA
tcatttagaaagtgaactgc

SEQ ID NO: 252 - DNA, 20 bp, synthetic construct
  source 1..20: mol_type = other DNA
tcacttaactgcagtgctgg

SEQ ID NO: 253 - DNA, 20 bp, synthetic construct
  source 1..20: mol_type = other DNA
tgggttccacaaagtacaag

SEQ ID NO: 254 - DNA, 20 bp, synthetic construct
  source 1..20: mol_type = other DNA
acttgggttccacaaagtac

SEQ ID NO: 255 - DNA, 20 bp, synthetic construct
  source 1..20: mol_type = other DNA
agccacttgggttccacaaa

SEQ ID NO: 256 - DNA, 20 bp, synthetic construct
  source 1..20: mol_type = other DNA
caaagccacttgggttccac

SEQ ID NO: 257 - DNA, 20 bp, synthetic construct
  source 1..20: mol_type = other DNA
tgctctctttctcacatacc

SEQ ID NO: 258 - DNA, 20 bp, synthetic construct
  source 1..20: mol_type = other DNA
ctgctctctttctcacatac

SEQ ID NO: 259 - DNA, 20 bp, synthetic construct
  source 1..20: mol_type = other DNA
actgctctctttctcacata

SEQ ID NO: 260 - DNA, 20 bp, synthetic construct
  source 1..20: mol_type = other DNA
tcaccgcccgcagccagcgc

SEQ ID NO: 261 - DNA, 20 bp, synthetic construct
  source 1..20: mol_type = other DNA
ctgctcagggaaccggcagg

SEQ ID NO: 262 - DNA, 20 bp, synthetic construct
  source 1..20: mol_type = other DNA
tggcacctgcttccaacccg

SEQ ID NO: 263 - DNA, 20 bp, synthetic construct
  source 1..20: mol_type = other DNA
acttcttcagagtttcctcg

SEQ ID NO: 264 - DNA, 20 bp, synthetic construct
  source 1..20: mol_type = other DNA
tgactatcaacttcttcaga

SEQ ID NO: 265 - DNA, 20 bp, synthetic construct
  source 1..20: mol_type = other DNA
gcctgactatcaacttcttc

SEQ ID NO: 266 - DNA, 20 bp, synthetic construct
  source 1..20: mol_type = other DNA
ttcagcctgactatcaactt

SEQ ID NO: 267 - DNA, 20 bp, synthetic construct
  source 1..20: mol_type = other DNA
ttgttcagcctgactatcaa

SEQ ID NO: 268 - DNA, 20 bp, synthetic construct
  source 1..20: mol_type = other DNA
gtttctatctgttttccttc

SEQ ID NO: 269 - DNA, 20 bp, synthetic construct
  source 1..20: mol_type = other DNA
cttgaaataacttggaggcg

SEQ ID NO: 270 - DNA, 20 bp, synthetic construct
  source 1..20: mol_type = other DNA
ataggagtccaagacgatca

SEQ ID NO: 271 - DNA, 20 bp, synthetic construct
  source 1..20: mol_type = other DNA
ttgcacagaagtgaccaacc

SEQ ID NO: 272 - DNA, 20 bp, synthetic construct
  source 1..20: mol_type = other DNA
gtcccattaagctttgcatt

SEQ ID NO: 273 - DNA, 20 bp, synthetic construct
  source 1..20: mol_type = other DNA
attggtgaacaccaaggact

SEQ ID NO: 274 - DNA, 20 bp, synthetic construct
  source 1..20: mol_type = other DNA
caagtttacactggcattat

SEQ ID NO: 275 - DNA, 20 bp, synthetic construct
  source 1..20: mol_type = other DNA
cctgaagttaggaggagatc

SEQ ID NO: 276 - DNA, 20 bp, synthetic construct
  source 1..20: mol_type = other DNA
catgaaaatatcactttctt

SEQ ID NO: 277 - DNA, 20 bp, synthetic construct
  source 1..20: mol_type = other DNA
tggcatcaaaaattaacatg

SEQ ID NO: 278 - DNA, 20 bp, synthetic construct
  source 1..20: mol_type = other DNA
gcatggcatcaaaaattaac

SEQ ID NO: 279 - DNA, 20 bp, synthetic construct
  source 1..20: mol_type = other DNA
gagtgcatggcatcaaaaat

SEQ ID NO: 280 - DNA, 20 bp, synthetic construct
  source 1..20: mol_type = other DNA
aatgagtgcatggcatcaaa

SEQ ID NO: 281 - DNA, 20 bp, synthetic construct
  source 1..20: mol_type = other DNA
acttcatcattggctggaaa

SEQ ID NO: 282 - DNA, 20 bp, synthetic construct
  source 1..20: mol_type = other DNA
ctctctcaaacagcacatgt

SEQ ID NO: 283 - DNA, 20 bp, synthetic construct
  source 1..20: mol_type = other DNA
ataatctttgttctcaacaa

SEQ ID NO: 284 - DNA, 20 bp, synthetic construct
  source 1..20: mol_type = other DNA
atttcctcttcatctttaaa

SEQ ID NO: 285 - DNA, 20 bp, synthetic construct
  source 1..20: mol_type = other DNA
aaggaatcgctagggaatgt

SEQ ID NO: 286 - DNA, 20 bp, synthetic construct
  source 1..20: mol_type = other DNA
ataacacctgacattgccac

SEQ ID NO: 287 - DNA, 20 bp, synthetic construct
  source 1..20: mol_type = other DNA
gctttcatagcttccaccac

SEQ ID NO: 288 - DNA, 20 bp, synthetic construct
  source 1..20: mol_type = other DNA
aatgctttcatagcttccac

SEQ ID NO: 289 - DNA, 20 bp, synthetic construct
  source 1..20: mol_type = other DNA
agggaatgctttcatagctt

SEQ ID NO: 290 - DNA, 20 bp, synthetic construct
  source 1..20: mol_type = other DNA
catagggaatgctttcatag

SEQ ID NO: 291 - DNA, 20 bp, synthetic construct
  source 1..20: mol_type = other DNA
ctttcactcatagggaatgc

SEQ ID NO: 292 - DNA, 20 bp, synthetic construct
  source 1..20: mol_type = other DNA
ctaatgtaagcctatggagc

SEQ ID NO: 293 - DNA, 20 bp, synthetic construct
  source 1..20: mol_type = other DNA
ccacaaactcatggacttcg

SEQ ID NO: 294 - DNA, 20 bp, synthetic construct
  source 1..20: mol_type = other DNA
gatctgcaatgctgcattct

SEQ ID NO: 295 - DNA, 20 bp, synthetic construct
  source 1..20: mol_type = other DNA
catcatcattctcttgattc

SEQ ID NO: 296 - DNA, 20 bp, synthetic construct
  source 1..20: mol_type = other DNA
tttgtaacaggcttccagcc

SEQ ID NO: 297 - DNA, 20 bp, synthetic construct
  source 1..20: mol_type = other DNA
agcatgcggcctcctgcacg

SEQ ID NO: 298 - DNA, 20 bp, synthetic construct
  source 1..20: mol_type = other DNA
ctcatgtaaactgttttggt

SEQ ID NO: 299 - DNA, 20 bp, synthetic construct
  source 1..20: mol_type = other DNA
acttccctatgagctgggaa

SEQ ID NO: 300 - DNA, 20 bp, synthetic construct
  source 1..20: mol_type = other DNA
ggaaaacttcctttgatgaa

SEQ ID NO: 301 - DNA, 20 bp, synthetic construct
  source 1..20: mol_type = other DNA
ttgataacagtatttttctg

SEQ ID NO: 302 - DNA, 20 bp, synthetic construct
  source 1..20: mol_type = other DNA
tatatgcttctgcattaact

SEQ ID NO: 303 - DNA, 20 bp, synthetic construct
  source 1..20: mol_type = other DNA
tgatttagcattttacagcc

SEQ ID NO: 304 - DNA, 20 bp, synthetic construct
  source 1..20: mol_type = other DNA
ctgctgccattatatccagg

SEQ ID NO: 305 - DNA, 20 bp, synthetic construct
  source 1..20: mol_type = other DNA
ggtaatgatgtctcatgacg

SEQ ID NO: 306 - DNA, 20 bp, synthetic construct
  source 1..20: mol_type = other DNA
caggcactataaaatgtaaa

SEQ ID NO: 307 - DNA, 20 bp, synthetic construct
  source 1..20: mol_type = other DNA
cttatgatgaaattctgtat

SEQ ID NO: 308 - DNA, 20 bp, synthetic construct
  source 1..20: mol_type = other DNA
tttgtgaatatcattcttga

SEQ ID NO: 309 - DNA, 20 bp, synthetic construct
  source 1..20: mol_type = other DNA
aatcccaggatttccaatga

SEQ ID NO: 310 - DNA, 20 bp, synthetic construct
  source 1..20: mol_type = other DNA
atttctgaatcccaggattt

SEQ ID NO: 311 - DNA, 20 bp, synthetic construct
  source 1..20: mol_type = other DNA
cacatttctgaatcccagga

SEQ ID NO: 312 - DNA, 20 bp, synthetic construct
  source 1..20: mol_type = other DNA
aatccacatttctgaatccc

SEQ ID NO: 313 - DNA, 20 bp, synthetic construct
  source 1..20: mol_type = other DNA
tttaatccacatttctgaat

SEQ ID NO: 314 - DNA, 20 bp, synthetic construct
  source 1..20: mol_type = other DNA
tcaggaaaatgtacaataga

SEQ ID NO: 315 - DNA, 20 bp, synthetic construct
  source 1..20: mol_type = other DNA
gaagcactgaatccatagca

SEQ ID NO: 316 - DNA, 20 bp, synthetic construct
  source 1..20: mol_type = other DNA
tgaacacattcttctttgta

SEQ ID NO: 317 - DNA, 20 bp, synthetic construct
  source 1..20: mol_type = other DNA
tataagctggaaaccagaat

SEQ ID NO: 318 - DNA, 20 bp, synthetic construct
  source 1..20: mol_type = other DNA
tctgaaatcctttagtctgt

SEQ ID NO: 319 - DNA, 20 bp, synthetic construct
  source 1..20: mol_type = other DNA
cagcttagaaaaagatgctg

SEQ ID NO: 320 - DNA, 20 bp, synthetic construct
  source 1..20: mol_type = other DNA
gacatttgatggaatattac

SEQ ID NO: 321 - DNA, 20 bp, synthetic construct
  source 1..20: mol_type = other DNA
agaggtttagaaactgttga

SEQ ID NO: 322 - DNA, 20 bp, synthetic construct
  source 1..20: mol_type = other DNA
ttttaagtaatcatccatag

SEQ ID NO: 323 - DNA, 20 bp, synthetic construct
  source 1..20: mol_type = other DNA
atgatgctgttattctgatc

SEQ ID NO: 324 - DNA, 20 bp, synthetic construct
  source 1..20: mol_type = other DNA
ttgcttgattggcatctgct

SEQ ID NO: 325 - DNA, 20 bp, synthetic construct
  source 1..20: mol_type = other DNA
ctttctcacatacctgacaa

SEQ ID NO: 326 - DNA, 20 bp, synthetic construct
  source 1..20: mol_type = other DNA
tctctttctcacatacctga

SEQ ID NO: 327 - DNA, 20 bp, synthetic construct
  source 1..20: mol_type = other DNA
ctgtgccatgattttacaaa

SEQ ID NO: 328 - DNA, 20 bp, synthetic construct
  source 1..20: mol_type = other DNA
cccttagggtgttttggaca

SEQ ID NO: 329 - DNA, 20 bp, synthetic construct
  source 1..20: mol_type = other DNA
ccttttttttgaaagaaatt

SEQ ID NO: 330 - DNA, 20 bp, synthetic construct
  source 1..20: mol_type = other DNA
tctaggagcttaaaatactg

SEQ ID NO: 331 - DNA, 20 bp, synthetic construct
  source 1..20: mol_type = other DNA
aaccagcaaatattcttctc

SEQ ID NO: 332 - DNA, 20 bp, synthetic construct
  source 1..20: mol_type = other DNA
ttcagagttctcacaatggg

SEQ ID NO: 333 - DNA, 20 bp, synthetic construct
  source 1..20: mol_type = other DNA
ccaaaatcccattggaaaat

SEQ ID NO: 334 - DNA, 20 bp, synthetic construct
  source 1..20: mol_type = other DNA
agcatgtaaggtgaaatctc

SEQ ID NO: 335 - DNA, 20 bp, synthetic construct
  source 1..20: mol_type = other DNA
gccaatacattctgtttggg

SEQ ID NO: 336 - DNA, 20 bp, synthetic construct
  source 1..20: mol_type = other DNA
cagacaataagcttcaggag

SEQ ID NO: 337 - DNA, 20 bp, synthetic construct
  source 1..20: mol_type = other DNA
atttttaagaaactctctgg

SEQ ID NO: 338 - DNA, 20 bp, synthetic construct
  source 1..20: mol_type = other DNA
cttggcccaaaagaatacag

SEQ ID NO: 339 - DNA, 20 bp, synthetic construct
  source 1..20: mol_type = other DNA
gcaacccaggaaaccattct

SEQ ID NO: 340 - DNA, 20 bp, synthetic construct
  source 1..20: mol_type = other DNA
tttcttcaacagagtttctc

SEQ ID NO: 341 - DNA, 20 bp, synthetic construct
  source 1..20: mol_type = other DNA
ccatttcttcaacagagttt

SEQ ID NO: 342 - DNA, 20 bp, synthetic construct
  source 1..20: mol_type = other DNA
atgcccatttcttcaacaga

SEQ ID NO: 343 - DNA, 20 bp, synthetic construct
  source 1..20: mol_type = other DNA
ataatgcccatttcttcaac

SEQ ID NO: 344 - DNA, 20 bp, synthetic construct
  source 1..20: mol_type = other DNA
gattttttgatgttcttcac

SEQ ID NO: 345 - DNA, 20 bp, synthetic construct
  source 1..20: mol_type = other DNA
taagagatctccttcctctg

SEQ ID NO: 346 - DNA, 20 bp, synthetic construct
  source 1..20: mol_type = other DNA
atctgagatattggaatggt

SEQ ID NO: 347 - DNA, 20 bp, synthetic construct
  source 1..20: mol_type = other DNA
acataatatttctaggcagg

SEQ ID NO: 348 - DNA, 20 bp, synthetic construct
  source 1..20: mol_type = other DNA
gagaaactctggagcttgtt

SEQ ID NO: 349 - DNA, 20 bp, synthetic construct
  source 1..20: mol_type = other DNA
tcataggctgctcggtaaac

SEQ ID NO: 350 - DNA, 20 bp, synthetic construct
  source 1..20: mol_type = other DNA
gtgatgtatgtttattaaaa

SEQ ID NO: 351 - DNA, 20 bp, synthetic construct
  source 1..20: mol_type = other DNA
gtggaggtggcaaagcacca

SEQ ID NO: 352 - DNA, 20 bp, synthetic construct
  source 1..20: mol_type = other DNA
ctccatcaccaacatccggg

SEQ ID NO: 353 - DNA, 20 bp, synthetic construct
  source 1..20: mol_type = other DNA
ttgtcctgctgaagcaggcg

SEQ ID NO: 354 - DNA, 20 bp, synthetic construct
  source 1..20: mol_type = other DNA
cgtggagtgcaatcctgtgc

SEQ ID NO: 355 - DNA, 20 bp, synthetic construct
  source 1..20: mol_type = other DNA
gtatataatcatggctgagt

SEQ ID NO: 356 - DNA, 20 bp, synthetic construct
  source 1..20: mol_type = other DNA
ggatacagtgtgaaaagcag

SEQ ID NO: 357 - DNA, 20 bp, synthetic construct
  source 1..20: mol_type = other DNA
gagcaatgccgtagtcagca

SEQ ID NO: 358 - DNA, 20 bp, synthetic construct
  source 1..20: mol_type = other DNA
tactgagcaatgccgtagtc

SEQ ID NO: 359 - DNA, 20 bp, synthetic construct
  source 1..20: mol_type = other DNA
cagtactgagcaatgccgta

SEQ ID NO: 360 - DNA, 20 bp, synthetic construct
  source 1..20: mol_type = other DNA
agcagtactgagcaatgccg

SEQ ID NO: 361 - DNA, 20 bp, synthetic construct
  source 1..20: mol_type = other DNA
acagcagtactgagcaatgc

SEQ ID NO: 362 - DNA, 20 bp, synthetic construct
  source 1..20: mol_type = other DNA
tctacagcagtactgagcaa

SEQ ID NO: 363 - DNA, 20 bp, synthetic construct
  source 1..20: mol_type = other DNA
ctggtgtgccctctgatgtt

SEQ ID NO: 364 - DNA, 20 bp, synthetic construct
  source 1..20: mol_type = other DNA
gttataaatgacatttcctc

SEQ ID NO: 365 - DNA, 20 bp, synthetic construct
  source 1..20: mol_type = other DNA
atgtcatagagtagtaaacc

SEQ ID NO: 366 - DNA, 20 bp, synthetic construct
  source 1..20: mol_type = other DNA
atttggaaacttcaaaccct

SEQ ID NO: 367 - DNA, 20 bp, synthetic construct
  source 1..20: mol_type = other DNA
actggatcaggtaattttcc

SEQ ID NO: 368 - DNA, 20 bp, synthetic construct
  source 1..20: mol_type = other DNA
ttaatttctcaaccataggc

SEQ ID NO: 369 - DNA, 20 bp, synthetic construct
  source 1..20: mol_type = other DNA
agaagtaggcctttcttgag

SEQ ID NO: 370 - DNA, 20 bp, synthetic construct
  source 1..20: mol_type = other DNA
agacagactaattcagctga

SEQ ID NO: 371 - DNA, 20 bp, synthetic construct
  source 1..20: mol_type = other DNA
ccatgcattcaacaattacg

SEQ ID NO: 372 - DNA, 20 bp, synthetic construct
  source 1..20: mol_type = other DNA
gcccagccaaatgcttgcat

SEQ ID NO: 373 - DNA, 20 bp, synthetic construct
  source 1..20: mol_type = other DNA
tttaagtcaagaaatgagag

SEQ ID NO: 374 - DNA, 20 bp, synthetic construct
  source 1..20: mol_type = other DNA
atattctactatcagcaact

SEQ ID NO: 375 - DNA, 20 bp, synthetic construct
  source 1..20: mol_type = other DNA
ccagctttccttttcaacag

SEQ ID NO: 376 - DNA, 20 bp, synthetic construct
  source 1..20: mol_type = other DNA
gtattgatgaccaggagagt

SEQ ID NO: 377 - DNA, 20 bp, synthetic construct
  source 1..20: mol_type = other DNA
aatcagtcatcttttctagg

SEQ ID NO: 378 - DNA, 20 bp, synthetic construct
  source 1..20: mol_type = other DNA
tttgctttgcttggaaaagg

SEQ ID NO: 379 - DNA, 20 bp, synthetic construct
  source 1..20: mol_type = other DNA
gctaacttgccatcagcggt

SEQ ID NO: 380 - DNA, 20 bp, synthetic construct
  source 1..20: mol_type = other DNA
aaggagcagctcctttaagc

SEQ ID NO: 381 - DNA, 20 bp, synthetic construct
  source 1..20: mol_type = other DNA
acacatcaatggagtactga

SEQ ID NO: 382 - DNA, 20 bp, synthetic construct
  source 1..20: mol_type = other DNA
ccccacattacatttctttc

SEQ ID NO: 383 - DNA, 20 bp, synthetic construct
  source 1..20: mol_type = other DNA
tggtgaaatcattagaaaag

SEQ ID NO: 384 - DNA, 20 bp, synthetic construct
  source 1..20: mol_type = other DNA
cataagaaaacagttggctt

SEQ ID NO: 385 - DNA, 20 bp, synthetic construct
  source 1..20: mol_type = other DNA
agtgtctaccaccactgtta

SEQ ID NO: 386 - DNA, 20 bp, synthetic construct
  source 1..20: mol_type = other DNA
cacacttccacaacagggct

SEQ ID NO: 387 - DNA, 20 bp, synthetic construct
  source 1..20: mol_type = other DNA
gcacgcagtctattagtcca

SEQ ID NO: 388 - DNA, 20 bp, synthetic construct
  source 1..20: mol_type = other DNA
gttttgattccttgttttct

SEQ ID NO: 389 - DNA, 20 bp, synthetic construct
  source 1..20: mol_type = other DNA
ctgaaggcagagggttttca

SEQ ID NO: 390 - DNA, 20 bp, synthetic construct
  source 1..20: mol_type = other DNA
aaaatatggcctcctccagt

SEQ ID NO: 391 - DNA, 20 bp, synthetic construct
  source 1..20: mol_type = other DNA
caaaagttgtaaattacacg

SEQ ID NO: 392 - DNA, 20 bp, synthetic construct
  source 1..20: mol_type = other DNA
taaggcttcctagctgtgct

SEQ ID NO: 393 - DNA, 20 bp, synthetic construct
  source 1..20: mol_type = other DNA
ttcagtatttttccggttgt

SEQ ID NO: 394 - DNA, 20 bp, synthetic construct
  source 1..20: mol_type = other DNA
caaacggtcaagcaagattg

SEQ ID NO: 395 - DNA, 20 bp, synthetic construct
  source 1..20: mol_type = other DNA
caatgtgtttttctaaattt

SEQ ID NO: 396 - DNA, 20 bp, synthetic construct
  source 1..20: mol_type = other DNA
tcttactcaacagatgttcg

SEQ ID NO: 397 - DNA, 20 bp, synthetic construct
  source 1..20: mol_type = other DNA
gaggagagaataattttcct

SEQ ID NO: 398 - DNA, 20 bp, synthetic construct
  source 1..20: mol_type = other DNA
gagtaccctttccatgtgaa

SEQ ID NO: 399 - DNA, 20 bp, synthetic construct
  source 1..20: mol_type = other DNA
aaaataataacattccttca

SEQ ID NO: 400 - DNA, 20 bp, synthetic construct
  source 1..20: mol_type = other DNA
aaaatacacatttactggta

SEQ ID NO: 401 - DNA, 20 bp, synthetic construct
  source 1..20: mol_type = other DNA
ctggtatttataagaaatat

SEQ ID NO: 402 - DNA, 20 bp, synthetic construct
  source 1..20: mol_type = other DNA
attaggtacttcacagattt

SEQ ID NO: 403 - DNA, 20 bp, synthetic construct
  source 1..20: mol_type = other DNA
aacaaaaaattatcggcctt

SEQ ID NO: 404 - DNA, 20 bp, synthetic construct
  source 1..20: mol_type = other DNA
cttaagcacagaatttaaaa

SEQ ID NO: 405 - DNA, 20 bp, synthetic construct
  source 1..20: mol_type = other DNA
ataccgtgcagatttctaga

SEQ ID NO: 406 - DNA, 20 bp, synthetic construct
  source 1..20: mol_type = other DNA
aagaaggaatacattacatg

SEQ ID NO: 407 - DNA, 20 bp, synthetic construct
  source 1..20: mol_type = other DNA
tttgaatatttacaagcata

SEQ ID NO: 408 - DNA, 20 bp, synthetic construct
  source 1..20: mol_type = other DNA
attagtgcaaattcatttga

SEQ ID NO: 409 - DNA, 20 bp, synthetic construct
  source 1..20: mol_type = other DNA
actttattagtgcaaattca

SEQ ID NO: 410 - DNA, 20 bp, synthetic construct
  source 1..20: mol_type = other DNA
aaaggactttattagtgcaa

SEQ ID NO: 411 - DNA, 20 bp, synthetic construct
  source 1..20: mol_type = other DNA
ccaacaaaggactttattag

SEQ ID NO: 412 - DNA, 20 bp, synthetic construct
  source 1..20: mol_type = other DNA
acataccaacaaaggacttt

SEQ ID NO: 413 - DNA, 20 bp, synthetic construct
  source 1..20: mol_type = other DNA
aagagaattcacataccaac

SEQ ID NO: 414 - DNA, 20 bp, synthetic construct
  source 1..20: mol_type = other DNA
aattgagtgaagttgtgtaa

SEQ ID NO: 415 - DNA, 20 bp, synthetic construct
  source 1..20: mol_type = other DNA
atgtcatgttttttcattag

SEQ ID NO: 416 - DNA, 20 bp, synthetic construct
  source 1..20: mol_type = other DNA
aaagagagtttctgtgtctt

SEQ ID NO: 417 - DNA, 20 bp, synthetic construct
  source 1..20: mol_type = other DNA
acaactctattatgtctagg

SEQ ID NO: 418 - DNA, 20 bp, synthetic construct
  source 1..20: mol_type = other DNA
tatacaaaattcagggtatc

SEQ ID NO: 419 - DNA, 20 bp, synthetic construct
  source 1..20: mol_type = other DNA
tagtggtatgaataaaaaaa

SEQ ID NO: 420 - DNA, 20 bp, synthetic construct
  source 1..20: mol_type = other DNA
agatgaatataagcattaga

SEQ ID NO: 421 - DNA, 20 bp, synthetic construct
  source 1..20: mol_type = other DNA
tatctgaatgatgtaggatc

SEQ ID NO: 422 - DNA, 20 bp, synthetic construct
  source 1..20: mol_type = other DNA
gtaggagctgtggaattcta

SEQ ID NO: 423 - DNA, 20 bp, synthetic construct
  source 1..20: mol_type = other DNA
cttcagcaactgaaaagtgt

SEQ ID NO: 424 - DNA, 20 bp, synthetic construct
  source 1..20: mol_type = other DNA
ctagggtggcagatattttt

SEQ ID NO: 425 - DNA, 20 bp, synthetic construct
  source 1..20: mol_type = other DNA
tattgtggtaagctatgtaa

SEQ ID NO: 426 - DNA, 20 bp, synthetic construct
  source 1..20: mol_type = other DNA
aaatgacctcaaattattac

SEQ ID NO: 427 - DNA, 20 bp, synthetic construct
  source 1..20: mol_type = other DNA
ggtcagggccaaagaattta

SEQ ID NO: 428 - DNA, 20 bp, synthetic construct
  source 1..20: mol_type = other DNA
actagttgtcctatcacagg

SEQ ID NO: 429 - DNA, 20 bp, synthetic construct
  source 1..20: mol_type = other DNA
gttttcacatagtaaaatgc

SEQ ID NO: 430 - DNA, 20 bp, synthetic construct
  source 1..20: mol_type = other DNA
tcatctttaagaatttgatt

SEQ ID NO: 431 - DNA, 20 bp, synthetic construct
  source 1..20: mol_type = other DNA
ataacaagttaaagcatagc

SEQ ID NO: 432 - DNA, 20 bp, synthetic construct
  source 1..20: mol_type = other DNA
ctggaacaaagagctctatt

SEQ ID NO: 433 - DNA, 20 bp, synthetic construct
  source 1..20: mol_type = other DNA
ctttggtaaaaaaaattgca

SEQ ID NO: 434 - DNA, 20 bp, synthetic construct
  source 1..20: mol_type = other DNA
attattccatttaaatatgg

SEQ ID NO: 435 - DNA, 20 bp, synthetic construct
  source 1..20: mol_type = other DNA
cctttattattccatttaaa

SEQ ID NO: 436 - DNA, 20 bp, synthetic construct
  source 1..20: mol_type = other DNA
aaaaacctttattattccat

SEQ ID NO: 437 - DNA, 20 bp, synthetic construct
  source 1..20: mol_type = other DNA
cctctttcagtttattgtga

SEQ ID NO: 438 - DNA, 20 bp, synthetic construct
  source 1..20: mol_type = other DNA
atagttgacaggaatttata

SEQ ID NO: 439 - DNA, 20 bp, synthetic construct
  source 1..20: mol_type = other DNA
gtttagtggaagtattaagg

SEQ ID NO: 440 - DNA, 20 bp, synthetic construct
  source 1..20: mol_type = other DNA
tatatgataacatcacacat

SEQ ID NO: 441 - DNA, 20 bp, synthetic construct
  source 1..20: mol_type = other DNA
ttccatagaacactctttat

SEQ ID NO: 442 - DNA, 20 bp, synthetic construct
  source 1..20: mol_type = other DNA
aggaaattatgctgtgttac

SEQ ID NO: 443 - DNA, 20 bp, synthetic construct
  source 1..20: mol_type = other DNA
agaaaaatggtttatttaag

SEQ ID NO: 444 - DNA, 20 bp, synthetic construct
  source 1..20: mol_type = other DNA
acactgaccatacacaagct

SEQ ID NO: 445 - DNA, 20 bp, synthetic construct
  source 1..20: mol_type = other DNA
gcctagctgtgctgtcatca

SEQ ID NO: 446 - DNA, 20 bp, synthetic construct
  source 1..20: mol_type = other DNA
taccagtcttatgtttcact

SEQ ID NO: 447 - DNA, 20 bp, synthetic construct
  source 1..20: mol_type = other DNA
atttcccatttttgccttag

SEQ ID NO: 448 - DNA, 20 bp, synthetic construct
  source 1..20: mol_type = other DNA
tgtattgctgcaagaaaaaa

SEQ ID NO: 449 - DNA, 20 bp, synthetic construct
  source 1..20: mol_type = other DNA
acgcaaatatatttatgcag

SEQ ID NO: 450 - DNA, 20 bp, synthetic construct
  source 1..20: mol_type = other DNA
atgttcaaaacattcattat

SEQ ID NO: 451 - DNA, 20 bp, synthetic construct
  source 1..20: mol_type = other DNA
taatagtttacagtcattaa

SEQ ID NO: 452 - DNA, 20 bp, synthetic construct
  source 1..20: mol_type = other DNA
tataacttcagttataagca

SEQ ID NO: 453 - DNA, 20 bp, synthetic construct
  source 1..20: mol_type = other DNA
agacaagcaagatctggtag

SEQ ID NO: 454 - DNA, 20 bp, synthetic construct
  source 1..20: mol_type = other DNA
acaggagctaacatttcaaa

SEQ ID NO: 455 - DNA, 20 bp, synthetic construct
  source 1..20: mol_type = other DNA
aaccgtcttggagtttatat

SEQ ID NO: 456 - DNA, 20 bp, synthetic construct
  source 1..20: mol_type = other DNA
tatactgatactatgtcaaa

SEQ ID NO: 457 - DNA, 20 bp, synthetic construct
  source 1..20: mol_type = other DNA
cagtatttatacattaccct

SEQ ID NO: 458 - DNA, 20 bp, synthetic construct
  source 1..20: mol_type = other DNA
ttttctaggtgacccttcaa

SEQ ID NO: 459 - DNA, 20 bp, synthetic construct
  source 1..20: mol_type = other DNA
cctttctgcttttgtgtacc

SEQ ID NO: 460 - DNA, 20 bp, synthetic construct
  source 1..20: mol_type = other DNA
aagttctttacactataaac

SEQ ID NO: 461 - DNA, 20 bp, synthetic construct
  source 1..20: mol_type = other DNA
gacattatgtagatatagat

SEQ ID NO: 462 - DNA, 20 bp, synthetic construct
  source 1..20: mol_type = other DNA
attattatttataaaaaact

SEQ ID NO: 463 - DNA, 20 bp, synthetic construct
  source 1..20: mol_type = other DNA
tgtatctctagaaaaagaaa

SEQ ID NO: 464 - DNA, 20 bp, synthetic construct
  source 1..20: mol_type = other DNA
aatcacagtcagaggttcct

SEQ ID NO: 465 - DNA, 20 bp, synthetic construct
  source 1..20: mol_type = other DNA
cccttttccaaactattcat

SEQ ID NO: 466 - DNA, 20 bp, synthetic construct
  source 1..20: mol_type = other DNA
gtgacaaagttgcattttat

SEQ ID NO: 467 - DNA, 20 bp, synthetic construct
  source 1..20: mol_type = other DNA
tctacaagagtttgctagtg

SEQ ID NO: 468 - DNA, 20 bp, synthetic construct
  source 1..20: mol_type = other DNA
aagtgctgaactctacaaga

SEQ ID NO: 469 - DNA, 20 bp, synthetic construct
  source 1..20: mol_type = other DNA
ctctcacttcgctatgacag

SEQ ID NO: 470 - DNA, 20 bp, synthetic construct
  source 1..20: mol_type = other DNA
aaccgtcaattttctaaaga

SEQ ID NO: 471 - DNA, 20 bp, synthetic construct
  source 1..20: mol_type = other DNA
ctattcaattaaaagcttat

SEQ ID NO: 472 - DNA, 20 bp, synthetic construct
  source 1..20: mol_type = other DNA
ctcaaggaaaaaacctgttt

SEQ ID NO: 473 - DNA, 20 bp, synthetic construct
  source 1..20: mol_type = other DNA
aaaggcggcaatttctgata

SEQ ID NO: 474 - DNA, 20 bp, synthetic construct
  source 1..20: mol_type = other DNA
tatacttgacatggtcaaaa

SEQ ID NO: 475 - DNA, 20 bp, synthetic construct
  source 1..20: mol_type = other DNA
ctccaattcattctattata

SEQ ID NO: 476 - DNA, 20 bp, synthetic construct
  source 1..20: mol_type = other DNA
aacatagctggtaaaattac

SEQ ID NO: 477 - DNA, 20 bp, synthetic construct
  source 1..20: mol_type = other DNA
aaacattcaatgaatagaag

SEQ ID NO: 478 - DNA, 20 bp, synthetic construct
  source 1..20: mol_type = other DNA
acggaagaaatttttcttca

SEQ ID NO: 479 - DNA, 20 bp, synthetic construct
  source 1..20: mol_type = other DNA
ccagtcttcgattctctgcc

SEQ ID NO: 480 - DNA, 20 bp, synthetic construct
  source 1..20: mol_type = other DNA
ttggctttacattattggaa

SEQ ID NO: 481 - DNA, 20 bp, synthetic construct
  source 1..20: mol_type = other DNA
gtggccgttgctcacgcctg

SEQ ID NO: 482 - DNA, 20 bp, synthetic construct
  source 1..20: mol_type = other DNA
tcttagacatgttgatatat

SEQ ID NO: 483 - DNA, 20 bp, synthetic construct
  source 1..20: mol_type = other DNA
tcttagcaggactgatgagg

SEQ ID NO: 484 - DNA, 20 bp, synthetic construct
  source 1..20: mol_type = other DNA
caaatcaattcattaccaag

SEQ ID NO: 485 - DNA, 20 bp, synthetic construct
  source 1..20: mol_type = other DNA
gctctagatctttataaatg

SEQ ID NO: 486 - DNA, 20 bp, synthetic construct
  source 1..20: mol_type = other DNA
tacttttcccagtataagcc

SEQ ID NO: 487 - DNA, 20 bp, synthetic construct
  source 1..20: mol_type = other DNA
ccttatgccttgttaagcaa

SEQ ID NO: 488 - DNA, 20 bp, synthetic construct
  source 1..20: mol_type = other DNA
gaaattagactggtaaactg

SEQ ID NO: 489 - DNA, 20 bp, synthetic construct
  source 1..20: mol_type = other DNA
atcccattctgggaactgca

SEQ ID NO: 490 - DNA, 20 bp, synthetic construct
  source 1..20: mol_type = other DNA
ttgtattccttgcaaaatgt

SEQ ID NO: 491 - DNA, 20 bp, synthetic construct
  source 1..20: mol_type = other DNA
ttagttgcaagatagaacat

SEQ ID NO: 492 - DNA, 20 bp, synthetic construct
  source 1..20: mol_type = other DNA
atggtctagtttccacagta

SEQ ID NO: 493 - DNA, 20 bp, synthetic construct
  source 1..20: mol_type = other DNA
agtaagttccatttggagtc

SEQ ID NO: 494 - DNA, 20 bp, synthetic construct
  source 1..20: mol_type = other DNA
gggaaattctagagaaaact

SEQ ID NO: 495 - DNA, 20 bp, synthetic construct
  source 1..20: mol_type = other DNA
tgtgaagcagcccttcctaa

SEQ ID NO: 496 - DNA, 20 bp, synthetic construct
  source 1..20: mol_type = other DNA
acttcaggtcacaccttcat

SEQ ID NO: 497 - DNA, 20 bp, synthetic construct
  source 1..20: mol_type = other DNA
cacatcaaattaatttcttc

SEQ ID NO: 498 - DNA, 20 bp, synthetic construct
  source 1..20: mol_type = other DNA
aaacagaatatgaaccatta

SEQ ID NO: 499 - DNA, 20 bp, synthetic construct
  source 1..20: mol_type = other DNA
acaaaacagaatatgaacca

SEQ ID NO: 500 - DNA, 20 bp, synthetic construct
  source 1..20: mol_type = other DNA
aaaacaaaacagaatatgaa

SEQ ID NO: 501 - DNA, 20 bp, synthetic construct
  source 1..20: mol_type = other DNA
tacaaaacaaaacagaatat

SEQ ID NO: 502 - DNA, 20 bp, synthetic construct
  source 1..20: mol_type = other DNA
tgtggataagaaaacattgt

SEQ ID NO: 503 - DNA, 20 bp, synthetic construct
  source 1..20: mol_type = other DNA
tcttgacttttgcattatga

SEQ ID NO: 504 - DNA, 20 bp, synthetic construct
  source 1..20: mol_type = other DNA
aaatgttaactgttcttttt

SEQ ID NO: 505 - DNA, 20 bp, synthetic construct
  source 1..20: mol_type = other DNA
tcagctatgacctgtttcct

SEQ ID NO: 506 - DNA, 20 bp, synthetic construct
  source 1..20: mol_type = other DNA
aaatcagctatgacctgttt

SEQ ID NO: 507 - DNA, 20 bp, synthetic construct
  source 1..20: mol_type = other DNA
gtaaaaaatactatgctgtt

SEQ ID NO: 508 - DNA, 20 bp, synthetic construct
  source 1..20: mol_type = other DNA
caaacattaacaattttgct

SEQ ID NO: 509 - DNA, 20 bp, synthetic construct
  source 1..20: mol_type = other DNA
acctctaataaattgtgctg

SEQ ID NO: 510 - DNA, 20 bp, synthetic construct
  source 1..20: mol_type = other DNA
gcatggaatagtaaaggccc

SEQ ID NO: 511 - DNA, 20 bp, synthetic construct
  source 1..20: mol_type = other DNA
attgctaggtagagaactta

SEQ ID NO: 512 - DNA, 20 bp, synthetic construct
  source 1..20: mol_type = other DNA
tctaataaatgaccaagtta

SEQ ID NO: 513 - DNA, 20 bp, synthetic construct
  source 1..20: mol_type = other DNA
gaactttatatatagttatc

SEQ ID NO: 514 - DNA, 20 bp, synthetic construct
  source 1..20: mol_type = other DNA
cttgtgggaaagcatgaatc

SEQ ID NO: 515 - DNA, 20 bp, synthetic construct
  source 1..20: mol_type = other DNA
tccaacagttaacgatcatt

SEQ ID NO: 516 - DNA, 20 bp, synthetic construct
  source 1..20: mol_type = other DNA
gatataatcatgatactaga

SEQ ID NO: 517 - DNA, 20 bp, synthetic construct
  source 1..20: mol_type = other DNA
cagttttagtcatataacaa

SEQ ID NO: 518 - DNA, 20 bp, synthetic construct
  source 1..20: mol_type = other DNA
tacagttttagtcatataac

SEQ ID NO: 519 - DNA, 20 bp, synthetic construct
  source 1..20: mol_type = other DNA
atatgtatatttatatacat

SEQ ID NO: 520 - DNA, 20 bp, synthetic construct
  source 1..20: mol_type = other DNA
taaatatgtatatttatata

SEQ ID NO: 521 - DNA, 20 bp, synthetic construct
  source 1..20: mol_type = other DNA
gtataaatatgtatatttat

SEQ ID NO: 522 - DNA, 20 bp, synthetic construct
  source 1..20: mol_type = other DNA
tgtgtataaatatgtatatt

SEQ ID NO: 523 - DNA, 20 bp, synthetic construct
  source 1..20: mol_type = other DNA
atctgtgtataaatatgtat

SEQ ID NO: 524 - DNA, 20 bp, synthetic construct
  source 1..20: mol_type = other DNA
tacatctgtgtataaatatg

SEQ ID NO: 525 - DNA, 20 bp, synthetic construct
  source 1..20: mol_type = other DNA
atatacatctgtgtataaat

SEQ ID NO: 526 - DNA, 20 bp, synthetic construct
  source 1..20: mol_type = other DNA
tttatatacatctgtgtata

SEQ ID NO: 527 - DNA, 20 bp, synthetic construct
  source 1..20: mol_type = other DNA
atatttatatacatctgtgt

SEQ ID NO: 528 - DNA, 20 bp, synthetic construct
  source 1..20: mol_type = other DNA
tgtatatttatatacatctg

SEQ ID NO: 529 - DNA, 20 bp, synthetic construct
  source 1..20: mol_type = other DNA
ttgtatatttatatacatct

SEQ ID NO: 530 - DNA, 20 bp, synthetic construct
  source 1..20: mol_type = other DNA
tatttgtatatttatataca

SEQ ID NO: 531 - DNA, 20 bp, synthetic construct
  source 1..20: mol_type = other DNA
ttatatttgtatatttatat

SEQ ID NO: 532 - DNA, 20 bp, synthetic construct
  source 1..20: mol_type = other DNA
tatttatatttgtatattta

SEQ ID NO: 533 - DNA, 20 bp, synthetic construct
  source 1..20: mol_type = other DNA
atatatttatatttgtatat

SEQ ID NO: 534 - DNA, 20 bp, synthetic construct
  source 1..20: mol_type = other DNA
tgtatatatttatatttgta

SEQ ID NO: 535 - DNA, 20 bp, synthetic construct
  source 1..20: mol_type = other DNA
aaatgtatatatttatattt

SEQ ID NO: 536 - DNA, 20 bp, synthetic construct
  source 1..20: mol_type = other DNA
tataaatgtatatatttata

SEQ ID NO: 537 - DNA, 20 bp, synthetic construct
  source 1..20: mol_type = other DNA
atatataaatgtatatattt

SEQ ID NO: 538 - DNA, 20 bp, synthetic construct
  source 1..20: mol_type = other DNA
tttatatataaatgtatata

SEQ ID NO: 539 - DNA, 20 bp, synthetic construct
  source 1..20: mol_type = other DNA
atatttatatataaatgtat

SEQ ID NO: 540 - DNA, 20 bp, synthetic construct
  source 1..20: mol_type = other DNA
tgtatatttatatataaatg

SEQ ID NO: 541 - DNA, 20 bp, synthetic construct
  source 1..20: mol_type = other DNA
atatgtatatttatatataa

SEQ ID NO: 542 - DNA, 20 bp, synthetic construct
  source 1..20: mol_type = other DNA
ccatgtttagaagaaatact

SEQ ID NO: 543 - DNA, 20 bp, synthetic construct
  source 1..20: mol_type = other DNA
attacatagtttggcaaaac

SEQ ID NO: 544 - DNA, 20 bp, synthetic construct
  source 1..20: mol_type = other DNA
actgcagaaatatgtacctt

SEQ ID NO: 545 - DNA, 20 bp, synthetic construct
  source 1..20: mol_type = other DNA
caccccaggaagaagtccca

SEQ ID NO: 546 - DNA, 20 bp, synthetic construct
  source 1..20: mol_type = other DNA
gttaaattacctttaacata

SEQ ID NO: 547 - DNA, 20 bp, synthetic construct
  source 1..20: mol_type = other DNA
tccttgaaagtatcctctac

SEQ ID NO: 548 - DNA, 20 bp, synthetic construct
  source 1..20: mol_type = other DNA
ccatcctatccagataaata

SEQ ID NO: 549 - DNA, 20 bp, synthetic construct
  source 1..20: mol_type = other DNA
aggtgtgctttaggagaagc

SEQ ID NO: 550 - DNA, 20 bp, synthetic construct
  source 1..20: mol_type = other DNA
ttattaaggcagaactccaa

SEQ ID NO: 551 - DNA, 20 bp, synthetic construct
  source 1..20: mol_type = other DNA
catcccaagtgcctacagac

SEQ ID NO: 552 - DNA, 20 bp, synthetic construct
  source 1..20: mol_type = other DNA
actttgaaagtggcagaaaa

SEQ ID NO: 553 - DNA, 20 bp, synthetic construct
  source 1..20: mol_type = other DNA
ttacagttattttcacaaag

SEQ ID NO: 554 - DNA, 20 bp, synthetic construct
  source 1..20: mol_type = other DNA
caaacattataatttctata

SEQ ID NO: 555 - DNA, 20 bp, synthetic construct
  source 1..20: mol_type = other DNA
tataagcatgtggaggtatc

SEQ ID NO: 556 - DNA, 20 bp, synthetic construct
  source 1..20: mol_type = other DNA
tgctatgtgctatacaatta

SEQ ID NO: 557 - DNA, 20 bp, synthetic construct
  source 1..20: mol_type = other DNA
cttacaagtctgcagttacg

SEQ ID NO: 558 - DNA, 20 bp, synthetic construct
  source 1..20: mol_type = other DNA
tgcccagaatctacagaatc

SEQ ID NO: 559 - DNA, 20 bp, synthetic construct
  source 1..20: mol_type = other DNA
tccagggctgcaactgtaca

SEQ ID NO: 560 - DNA, 20 bp, synthetic construct
  source 1..20: mol_type = other DNA
gttctgtggacactgagata

SEQ ID NO: 561 - DNA, 20 bp, synthetic construct
  source 1..20: mol_type = other DNA
gctttgcttgttaactgaaa

SEQ ID NO: 562 - DNA, 20 bp, synthetic construct
  source 1..20: mol_type = other DNA
tttctctcaggtatttaagc

SEQ ID NO: 563 - DNA, 20 bp, synthetic construct
  source 1..20: mol_type = other DNA
gacttcttataaggtatttt

SEQ ID NO: 564 - DNA, 20 bp, synthetic construct
  source 1..20: mol_type = other DNA
ggctggtacccaaacttgtc

SEQ ID NO: 565 - DNA, 20 bp, synthetic construct
  source 1..20: mol_type = other DNA
caaggctggtacccaaactt

SEQ ID NO: 566 - DNA, 20 bp, synthetic construct
  source 1..20: mol_type = other DNA
acaatcccagcaggtaggtg

SEQ ID NO: 567 - DNA, 20 bp, synthetic construct
  source 1..20: mol_type = other DNA
atccttctgacctacgatgg

SEQ ID NO: 568 - DNA, 20 bp, synthetic construct
  source 1..20: mol_type = other DNA
ctttgaactcataagataga

SEQ ID NO: 569 - DNA, 20 bp, synthetic construct
  source 1..20: mol_type = other DNA
gcttattgaaagactgatct

SEQ ID NO: 570 - DNA, 20 bp, synthetic construct
  source 1..20: mol_type = other DNA
gaaggaagagaacaggtatg

SEQ ID NO: 571 - DNA, 20 bp, synthetic construct
  source 1..20: mol_type = other DNA
cgcctctctcacgctgcctg

SEQ ID NO: 572 - DNA, 20 bp, synthetic construct
  source 1..20: mol_type = other DNA
tgcaaacaattttaataaac

SEQ ID NO: 573 - DNA, 20 bp, synthetic construct
  source 1..20: mol_type = other DNA
tgactaccatggacctccaa

SEQ ID NO: 574 - DNA, 20 bp, synthetic construct
  source 1..20: mol_type = other DNA
ccttcactgggtctcacttg

SEQ ID NO: 575 - DNA, 20 bp, synthetic construct
  source 1..20: mol_type = other DNA
actaagctgaaactatgaat

SEQ ID NO: 576 - DNA, 20 bp, synthetic construct
  source 1..20: mol_type = other DNA
ctgattgattgttaactaac

SEQ ID NO: 577 - DNA, 20 bp, synthetic construct
  source 1..20: mol_type = other DNA
ttataagtaagtagatttga

SEQ ID NO: 578 - DNA, 20 bp, synthetic construct
  source 1..20: mol_type = other DNA
agattgttgcacaaatattt

SEQ ID NO: 579 - DNA, 20 bp, synthetic construct
  source 1..20: mol_type = other DNA
tactattcaaatggatataa

SEQ ID NO: 580 - DNA, 20 bp, synthetic construct
  source 1..20: mol_type = other DNA
gaactatgctaaaaacacta

SEQ ID NO: 581 - DNA, 20 bp, synthetic construct
  source 1..20: mol_type = other DNA
ttttgtgtgagtaggctgtg

SEQ ID NO: 582 - DNA, 20 bp, synthetic construct
  source 1..20: mol_type = other DNA
tatattcaacataccctgtt

SEQ ID NO: 583 - DNA, 20 bp, synthetic construct
  source 1..20: mol_type = other DNA
tacaacataaattcttgcca

SEQ ID NO: 584 - DNA, 20 bp, synthetic construct
  source 1..20: mol_type = other DNA
aatcttactgtcaatatagt

SEQ ID NO: 585 - DNA, 20 bp, synthetic construct
  source 1..20: mol_type = other DNA
ttaaaaggaagtaaccatgt

SEQ ID NO: 586 - DNA, 20 bp, synthetic construct
  source 1..20: mol_type = other DNA
tggtatccctcctaagtgct

SEQ ID NO: 587 - DNA, 20 bp, synthetic construct
  source 1..20: mol_type = other DNA
ctctcttggctcccgactgc

SEQ ID NO: 588 - DNA, 20 bp, synthetic construct
  source 1..20: mol_type = other DNA
taccttatttggaactctgc

SEQ ID NO: 589 - DNA, 20 bp, synthetic construct
  source 1..20: mol_type = other DNA
ttacttatatgtaatttgtt

SEQ ID NO: 590 - DNA, 20 bp, synthetic construct
  source 1..20: mol_type = other DNA
catcctgtaaacctttttta

SEQ ID NO: 591 - DNA, 20 bp, synthetic construct
  source 1..20: mol_type = other DNA
aaagattaaattaagctgca

SEQ ID NO: 592 - DNA, 20 bp, synthetic construct
  source 1..20: mol_type = other DNA
acattaggaatctcacctca

SEQ ID NO: 593 - DNA, 20 bp, synthetic construct
  source 1..20: mol_type = other DNA
ctgaatataaatattatcta

SEQ ID NO: 594 - DNA, 20 bp, synthetic construct
  source 1..20: mol_type = other DNA
atgtatagctagaatgagga

SEQ ID NO: 595 - DNA, 20 bp, synthetic construct
  source 1..20: mol_type = other DNA
agatgcaactcaagaaaact

SEQ ID NO: 596 - DNA, 20 bp, synthetic construct
  source 1..20: mol_type = other DNA
tatttataaagcacctatct

SEQ ID NO: 597 - DNA, 20 bp, synthetic construct
  source 1..20: mol_type = other DNA
aaattatatcaaattgatat

SEQ ID NO: 598 - DNA, 20 bp, synthetic construct
  source 1..20: mol_type = other DNA
ttttatagaggctgaggaga

SEQ ID NO: 599 - DNA, 20 bp, synthetic construct
  source 1..20: mol_type = other DNA
gccaaactttaaagatgcag

SEQ ID NO: 600 - DNA, 20 bp, synthetic construct
  source 1..20: mol_type = other DNA
cgaataaactcagctagctg

SEQ ID NO: 601 - DNA, 20 bp, synthetic construct
  source 1..20: mol_type = other DNA
gacagttattatatatcatg

SEQ ID NO: 602 - DNA, 20 bp, synthetic construct
  source 1..20: mol_type = other DNA
aaatttattcttaatctccc

SEQ ID NO: 603 - DNA, 20 bp, synthetic construct
  source 1..20: mol_type = other DNA
aaaacaagtgaatgctacag

SEQ ID NO: 604 - DNA, 20 bp, synthetic construct
  source 1..20: mol_type = other DNA
ctcttatgatgctgagtatc

SEQ ID NO: 605 - DNA, 20 bp, synthetic construct
  source 1..20: mol_type = other DNA
atgttttaatgaaagattgg

SEQ ID NO: 606 - DNA, 20 bp, synthetic construct
  source 1..20: mol_type = other DNA
ttaactatagatatattggg

SEQ ID NO: 607 - DNA, 20 bp, synthetic construct
  source 1..20: mol_type = other DNA
ggcaaaatgaataaacagta

SEQ ID NO: 608 - DNA, 20 bp, synthetic construct
  source 1..20: mol_type = other DNA
ttgaatatttacctgacaaa

SEQ ID NO: 609 - DNA, 20 bp, synthetic construct
  source 1..20: mol_type = other DNA
agtgttacacaactttggcc

SEQ ID NO: 610 - DNA, 20 bp, synthetic construct
  source 1..20: mol_type = other DNA
gagggctttaaagaaagata

SEQ ID NO: 611 - DNA, 20 bp, synthetic construct
  source 1..20: mol_type = other DNA
tgtagtacagttgtatcagg

SEQ ID NO: 612 - DNA, 20 bp, synthetic construct
  source 1..20: mol_type = other DNA
taaacctaatacataatcct

SEQ ID NO: 613 - DNA, 20 bp, synthetic construct
  source 1..20: mol_type = other DNA
tctttaaacctaatacataa

SEQ ID NO: 614 - DNA, 20 bp, synthetic construct
  source 1..20: mol_type = other DNA
attagaacctactggacctt

SEQ ID NO: 615 - DNA, 20 bp, synthetic construct
  source 1..20: mol_type = other DNA
ttttctctaagatatgccat

SEQ ID NO: 616 - DNA, 20 bp, synthetic construct
  source 1..20: mol_type = other DNA
gctcatagcaaaattaaaag

SEQ ID NO: 617 - DNA, 20 bp, synthetic construct
  source 1..20: mol_type = other DNA
tttcatttaatgtagcactg

SEQ ID NO: 618 - DNA, 20 bp, synthetic construct
  source 1..20: mol_type = other DNA
agcaactgagacttggattt

SEQ ID NO: 619 - DNA, 20 bp, synthetic construct
  source 1..20: mol_type = other DNA
acatttagtgtgaacaaatg

SEQ ID NO: 620 - DNA, 20 bp, synthetic construct
  source 1..20: mol_type = other DNA
tgctagtgagtgcatcataa

SEQ ID NO: 621 - DNA, 20 bp, synthetic construct
  source 1..20: mol_type = other DNA
tggatgggtacttttctcta

SEQ ID NO: 622 - DNA, 20 bp, synthetic construct
  source 1..20: mol_type = other DNA
aggtagagagagagtaacac

SEQ ID NO: 623 - DNA, 20 bp, synthetic construct
  source 1..20: mol_type = other DNA
atttagagctaggtagagag

SEQ ID NO: 624 - DNA, 20 bp, synthetic construct
  source 1..20: mol_type = other DNA
tgagaaataaagtgctatag

SEQ ID NO: 625 - DNA, 20 bp, synthetic construct
  source 1..20: mol_type = other DNA
tgaatggtagtatatgtgag

SEQ ID NO: 626 - DNA, 20 bp, synthetic construct
  source 1..20: mol_type = other DNA
acattgtgaggtcaaaaaag

SEQ ID NO: 627 - DNA, 20 bp, synthetic construct
  source 1..20: mol_type = other DNA
tccctctccaatgggcccac

SEQ ID NO: 628 - DNA, 20 bp, synthetic construct
  source 1..20: mol_type = other DNA
ttccagagtaatatgttatg

SEQ ID NO: 629 - DNA, 20 bp, synthetic construct
  source 1..20: mol_type = other DNA
gataaaccccaagaaggcaa

SEQ ID NO: 630 - DNA, 20 bp, synthetic construct
  source 1..20: mol_type = other DNA
tacattatgtattagctcta

SEQ ID NO: 631 - DNA, 20 bp, synthetic construct
  source 1..20: mol_type = other DNA
gtgttcaagtcatagaaatg

SEQ ID NO: 632 - DNA, 20 bp, synthetic construct
  source 1..20: mol_type = other DNA
aaccaattagtataacattt

SEQ ID NO: 633 - DNA, 20 bp, synthetic construct
  source 1..20: mol_type = other DNA
ctcattttttgccctctcaa

SEQ ID NO: 634 - DNA, 20 bp, synthetic construct
  source 1..20: mol_type = other DNA
taattttcaaagcgcatgaa

SEQ ID NO: 635 - DNA, 20 bp, synthetic construct
  source 1..20: mol_type = other DNA
atgttaattttcaaagcgca

SEQ ID NO: 636 - DNA, 20 bp, synthetic construct
  source 1..20: mol_type = other DNA
gaagaaacttttttggataa

SEQ ID NO: 637 - DNA, 20 bp, synthetic construct
  source 1..20: mol_type = other DNA
aataaatttggcaacttata

SEQ ID NO: 638 - DNA, 20 bp, synthetic construct
  source 1..20: mol_type = other DNA
gagaaagtaacacaaacaat

SEQ ID NO: 639 - DNA, 20 bp, synthetic construct
  source 1..20: mol_type = other DNA
caaatcctcaattacaactt

SEQ ID NO: 640 - DNA, 20 bp, synthetic construct
  source 1..20: mol_type = other DNA
accaacaaatcctcaattac

SEQ ID NO: 641 - DNA, 20 bp, synthetic construct
  source 1..20: mol_type = other DNA
ggagatagagatcaacattt

SEQ ID NO: 642 - DNA, 20 bp, synthetic construct
  source 1..20: mol_type = other DNA
aattaagggccatatacata

SEQ ID NO: 643 - DNA, 20 bp, synthetic construct
  source 1..20: mol_type = other DNA
acccaattatgaggataaaa

SEQ ID NO: 644 - DNA, 20 bp, synthetic construct
  source 1..20: mol_type = other DNA
tcatttattggagaagagga

SEQ ID NO: 645 - DNA, 20 bp, synthetic construct
  source 1..20: mol_type = other DNA
aaaccaaactatggagttta

SEQ ID NO: 646 - DNA, 20 bp, synthetic construct
  source 1..20: mol_type = other DNA
aagtcctgtcctcaaagagt

SEQ ID NO: 647 - DNA, 20 bp, synthetic construct
  source 1..20: mol_type = other DNA
aacaagtcctgtcctcaaag

SEQ ID NO: 648 - DNA, 20 bp, synthetic construct
  source 1..20: mol_type = other DNA
aacaaacaaagtgccatcta

SEQ ID NO: 649 - DNA, 20 bp, synthetic construct
  source 1..20: mol_type = other DNA
attatagaggcttattaacc

SEQ ID NO: 650 - DNA, 20 bp, synthetic construct
  source 1..20: mol_type = other DNA
tagagttgaaagcttccttc

SEQ ID NO: 651 - DNA, 20 bp, synthetic construct
  source 1..20: mol_type = other DNA
ccatctgaggaacttaagtc

SEQ ID NO: 652 - DNA, 20 bp, synthetic construct
  source 1..20: mol_type = other DNA
gtcaaactcttcagagtctg

SEQ ID NO: 653 - DNA, 20 bp, synthetic construct
  source 1..20: mol_type = other DNA
tatatagtatatatataata

SEQ ID NO: 654 - DNA, 20 bp, synthetic construct
  source 1..20: mol_type = other DNA
ttatatatagtatatatata

SEQ ID NO: 655 - DNA, 20 bp, synthetic construct
  source 1..20: mol_type = other DNA
gtattatatatagtatatat

SEQ ID NO: 656 - DNA, 20 bp, synthetic construct
  source 1..20: mol_type = other DNA
taagtattatatatagtata

SEQ ID NO: 657 - DNA, 20 bp, synthetic construct
  source 1..20: mol_type = other DNA
taataagtattatatatagt

SEQ ID NO: 658 - DNA, 20 bp, synthetic construct
  source 1..20: mol_type = other DNA
atataataagtattatatat

SEQ ID NO: 659 - DNA, 20 bp, synthetic construct
  source 1..20: mol_type = other DNA
tatatataataagtattata

SEQ ID NO: 660 - DNA, 20 bp, synthetic construct
  source 1..20: mol_type = other DNA
tttcatagttttatagcatt

SEQ ID NO: 661 - DNA, 20 bp, synthetic construct
  source 1..20: mol_type = other DNA
gtcttatagttgggaacgaa

SEQ ID NO: 662 - DNA, 20 bp, synthetic construct
  source 1..20: mol_type = other DNA
actatcattttaacctctga

SEQ ID NO: 663 - DNA, 20 bp, synthetic construct
  source 1..20: mol_type = other DNA
acagtaggccaagtaactat

SEQ ID NO: 664 - DNA, 20 bp, synthetic construct
  source 1..20: mol_type = other DNA
aagtgatgataataatttgc

SEQ ID NO: 665 - DNA, 20 bp, synthetic construct
  source 1..20: mol_type = other DNA
tggccaatattcaggagggt

SEQ ID NO: 666 - DNA, 20 bp, synthetic construct
  source 1..20: mol_type = other DNA
gctttgcttactagtgagtg

SEQ ID NO: 667 - DNA, 20 bp, synthetic construct
  source 1..20: mol_type = other DNA
gtttgaaggaatagctgaca

SEQ ID NO: 668 - DNA, 20 bp, synthetic construct
  source 1..20: mol_type = other DNA
agtgtttgaaggaatagctg

SEQ ID NO: 669 - DNA, 20 bp, synthetic construct
  source 1..20: mol_type = other DNA
catagtgtttgaaggaatag

SEQ ID NO: 670 - DNA, 20 bp, synthetic construct
  source 1..20: mol_type = other DNA
agccatagtgtttgaaggaa

SEQ ID NO: 671 - DNA, 20 bp, synthetic construct
  source 1..20: mol_type = other DNA
aaaagccatagtgtttgaag

SEQ ID NO: 672 - DNA, 20 bp, synthetic construct
  source 1..20: mol_type = other DNA
ctaaaaagccatagtgtttg

SEQ ID NO: 673 - DNA, 20 bp, synthetic construct
  source 1..20: mol_type = other DNA
attctaaaaagccatagtgt

SEQ ID NO: 674 - DNA, 20 bp, synthetic construct
  source 1..20: mol_type = other DNA
gcagcatcatgcaagcagca

SEQ ID NO: 675 - DNA, 20 bp, synthetic construct
  source 1..20: mol_type = other DNA
attgcagcatcatgcaagca

SEQ ID NO: 676 - DNA, 20 bp, synthetic construct
  source 1..20: mol_type = other DNA
tggcggaatgcagaaattta

SEQ ID NO: 677 - DNA, 20 bp, synthetic construct
  source 1..20: mol_type = other DNA
gtgggaaggaagaaatgtgc

SEQ ID NO: 678 - DNA, 20 bp, synthetic construct
  source 1..20: mol_type = other DNA
agcatattaatgccaaatat

SEQ ID NO: 679 - DNA, 20 bp, synthetic construct
  source 1..20: mol_type = other DNA
aaaggcaaatgacacacagc

SEQ ID NO: 680 - DNA, 20 bp, synthetic construct
  source 1..20: mol_type = other DNA
attagtctggctaagaagaa

SEQ ID NO: 681 - DNA, 20 bp, synthetic construct
  source 1..20: mol_type = other DNA
acagagctgaggtctgcaac

SEQ ID NO: 682 - DNA, 20 bp, synthetic construct
  source 1..20: mol_type = other DNA
aagctcaggagttcagaaaa

SEQ ID NO: 683 - DNA, 20 bp, synthetic construct
  source 1..20: mol_type = other DNA
ggtttctggatattagaaca

SEQ ID NO: 684 - DNA, 20 bp, synthetic construct
  source 1..20: mol_type = other DNA
ttgtcagcaaccgatcaaag

SEQ ID NO: 685 - DNA, 20 bp, synthetic construct
  source 1..20: mol_type = other DNA
caatttggagtctacaatga

SEQ ID NO: 686 - DNA, 20 bp, synthetic construct
  source 1..20: mol_type = other DNA
aaatgtaaccttacgacatt

SEQ ID NO: 687 - DNA, 20 bp, synthetic construct
  source 1..20: mol_type = other DNA
taatgctaacagcaacaagg

SEQ ID NO: 688 - DNA, 20 bp, synthetic construct
  source 1..20: mol_type = other DNA
tcacctttacccttgtgatt

SEQ ID NO: 689 - DNA, 20 bp, synthetic construct
  source 1..20: mol_type = other DNA
caggccaaataggactctat

SEQ ID NO: 690 - DNA, 20 bp, synthetic construct
  source 1..20: mol_type = other DNA
agtcatattagtttctaatt

SEQ ID NO: 691 - DNA, 20 bp, synthetic construct
  source 1..20: mol_type = other DNA
ctgctctgctaatgggctgg

SEQ ID NO: 692 - DNA, 20 bp, synthetic construct
  source 1..20: mol_type = other DNA
ttcatgtatctcttaaccca

SEQ ID NO: 693 - DNA, 20 bp, synthetic construct
  source 1..20: mol_type = other DNA
acttccatatttacctgcaa

SEQ ID NO: 694 - DNA, 20 bp, synthetic construct
  source 1..20: mol_type = other DNA
tgcactaaactcatttgaca

SEQ ID NO: 695 - DNA, 20 bp, synthetic construct
  source 1..20: mol_type = other DNA
gcatcatctcagggagccat

SEQ ID NO: 696 - DNA, 20 bp, synthetic construct
  source 1..20: mol_type = other DNA
cagcatatctcagcatacct

SEQ ID NO: 697 - DNA, 20 bp, synthetic construct
  source 1..20: mol_type = other DNA
caaacagtgaaacatggaat

SEQ ID NO: 698 - DNA, 20 bp, synthetic construct
  source 1..20: mol_type = other DNA
ttcaattgactaattcagta

SEQ ID NO: 699 - DNA, 20 bp, synthetic construct
  source 1..20: mol_type = other DNA
gctgattgcaatgtttcaat

SEQ ID NO: 700 - DNA, 20 bp, synthetic construct
  source 1..20: mol_type = other DNA
aaatcacattatccatgaca

SEQ ID NO: 701 - DNA, 20 bp, synthetic construct
  source 1..20: mol_type = other DNA
aatagctgtcagacaagttg

SEQ ID NO: 702 - DNA, 20 bp, synthetic construct
  source 1..20: mol_type = other DNA
ttagagcttctgcaccatga

SEQ ID NO: 703 - DNA, 20 bp, synthetic construct
  source 1..20: mol_type = other DNA
ttccacctgattaattgaat

SEQ ID NO: 704 - DNA, 20 bp, synthetic construct
  source 1..20: mol_type = other DNA
attttttaaagagtttgtgc

SEQ ID NO: 705 - DNA, 20 bp, synthetic construct
  source 1..20: mol_type = other DNA
tataaactcataggccctgg

SEQ ID NO: 706 - DNA, 20 bp, synthetic construct
  source 1..20: mol_type = other DNA
gtttaaggaatacttaaaca

SEQ ID NO: 707 - DNA, 20 bp, synthetic construct
  source 1..20: mol_type = other DNA
tgccctgagaatgaaataac

SEQ ID NO: 708 - DNA, 20 bp, synthetic construct
  source 1..20: mol_type = other DNA
tttgatggattctacttgca

SEQ ID NO: 709 - DNA, 20 bp, synthetic construct
  source 1..20: mol_type = other DNA
ctcaaagtaactactgcatt

SEQ ID NO: 710 - DNA, 20 bp, synthetic construct
  source 1..20: mol_type = other DNA
tctaaaaatctaataagtct

SEQ ID NO: 711 - DNA, 20 bp, synthetic construct
  source 1..20: mol_type = other DNA
tactccaaggttttatgagc

SEQ ID NO: 712 - DNA, 20 bp, synthetic construct
  source 1..20: mol_type = other DNA
aagagataattacagtccct

SEQ ID NO: 713 - DNA, 20 bp, synthetic construct
  source 1..20: mol_type = other DNA
ctaaacgcaaaactttctga

SEQ ID NO: 714 - DNA, 20 bp, synthetic construct
  source 1..20: mol_type = other DNA
tagaatacaagattttattg

SEQ ID NO: 715 - DNA, 20 bp, synthetic construct
  source 1..20: mol_type = other DNA
tgagcacctaaacatgctac

SEQ ID NO: 716 - DNA, 20 bp, synthetic construct
  source 1..20: mol_type = other DNA
acagcatcgcaggtcttgta

SEQ ID NO: 717 - DNA, 20 bp, synthetic construct
  source 1..20: mol_type = other DNA
aatgcatttcatagttgtcc

SEQ ID NO: 718 - DNA, 20 bp, synthetic construct
  source 1..20: mol_type = other DNA
ttctctatttgagaatcgcc

SEQ ID NO: 719 - DNA, 20 bp, synthetic construct
  source 1..20: mol_type = other DNA
aaatttcaagttggagtagg

SEQ ID NO: 720 - DNA, 20 bp, synthetic construct
  source 1..20: mol_type = other DNA
gtcatatagtggcccctaaa

SEQ ID NO: 721 - DNA, 20 bp, synthetic construct
  source 1..20: mol_type = other DNA
cactggtatgcccttccaac

SEQ ID NO: 722 - DNA, 20 bp, synthetic construct
  source 1..20: mol_type = other DNA
gaatttcttacttgtcttaa

SEQ ID NO: 723 - DNA, 20 bp, synthetic construct
  source 1..20: mol_type = other DNA
gctacataaaataaatcacc

SEQ ID NO: 724 - DNA, 20 bp, synthetic construct
  source 1..20: mol_type = other DNA
agagtctgaagtatctagaa

SEQ ID NO: 725 - DNA, 20 bp, synthetic construct
  source 1..20: mol_type = other DNA
tgaagcctggaaccagttta

SEQ ID NO: 726 - DNA, 20 bp, synthetic construct
  source 1..20: mol_type = other DNA
cctaaagccaattagcacaa

SEQ ID NO: 727 - DNA, 20 bp, synthetic construct
  source 1..20: mol_type = other DNA
agtgtagccactaagaattt

SEQ ID NO: 728 - DNA, 20 bp, synthetic construct
  source 1..20: mol_type = other DNA
cttatacactaattggctct

SEQ ID NO: 729 - DNA, 20 bp, synthetic construct
  source 1..20: mol_type = other DNA
tttcttccaccattccctta

SEQ ID NO: 730 - DNA, 20 bp, synthetic construct
  source 1..20: mol_type = other DNA
ctcactaattgcaaagaaaa

SEQ ID NO: 731 - DNA, 20 bp, synthetic construct
  source 1..20: mol_type = other DNA
caaagcttcagactgtgatc

SEQ ID NO: 732 - DNA, 20 bp, synthetic construct
  source 1..20: mol_type = other DNA
tcagagaggcccgccatggg

SEQ ID NO: 733 - DNA, 20 bp, synthetic construct
  source 1..20: mol_type = other DNA
ttcacatggctgaagtcttg

SEQ ID NO: 734 - DNA, 20 bp, synthetic construct
  source 1..20: mol_type = other DNA
atctactgaattctggttag

SEQ ID NO: 735 - DNA, 20 bp, synthetic construct
  source 1..20: mol_type = other DNA
gcacacagtgtagtcatact

SEQ ID NO: 736 - DNA, 20 bp, synthetic construct
  source 1..20: mol_type = other DNA
aacccaagattccccctggt

SEQ ID NO: 737 - DNA, 20 bp, synthetic construct
  source 1..20: mol_type = other DNA
tggagaagtaagctaacagt

SEQ ID NO: 738 - DNA, 20 bp, synthetic construct
  source 1..20: mol_type = other DNA
taactgaaaattcaagcctg

SEQ ID NO: 739 - DNA, 20 bp, synthetic construct
  source 1..20: mol_type = other DNA
cttaaggaaaatgagctctc

SEQ ID NO: 740 - DNA, 20 bp, synthetic construct
  source 1..20: mol_type = other DNA
tataatatctagctttccct

SEQ ID NO: 741 - DNA, 20 bp, synthetic construct
  source 1..20: mol_type = other DNA
cagagggagaaaaacactga

SEQ ID NO: 742 - DNA, 20 bp, synthetic construct
  source 1..20: mol_type = other DNA
cccttgagggtgtcacaatc

SEQ ID NO: 743 - DNA, 20 bp, synthetic construct
  source 1..20: mol_type = other DNA
atctttgtatctctgctccc

SEQ ID NO: 744 - DNA, 20 bp, synthetic construct
  source 1..20: mol_type = other DNA
ttgaaataataagtaaagat

SEQ ID NO: 745 - DNA, 20 bp, synthetic construct
  source 1..20: mol_type = other DNA
ataagacatgcctctttaag

SEQ ID NO: 746 - DNA, 20 bp, synthetic construct
  source 1..20: mol_type = other DNA
agtacatattatttaactgc

SEQ ID NO: 747 - DNA, 20 bp, synthetic construct
  source 1..20: mol_type = other DNA
actgttggttttggctcaca

SEQ ID NO: 748 - DNA, 20 bp, synthetic construct
  source 1..20: mol_type = other DNA
tctggagactgacccacgca

SEQ ID NO: 749 - DNA, 20 bp, synthetic construct
  source 1..20: mol_type = other DNA
gctgagtggaggtatctgcc

SEQ ID NO: 750 - DNA, 20 bp, synthetic construct
  source 1..20: mol_type = other DNA
atatggtttaggagagacta

SEQ ID NO: 751 - DNA, 20 bp, synthetic construct
  source 1..20: mol_type = other DNA
atacttaactcatggataga

SEQ ID NO: 752 - DNA, 20 bp, synthetic construct
  source 1..20: mol_type = other DNA
aaaagtgcaattgccatagg

SEQ ID NO: 753 - DNA, 20 bp, synthetic construct
  source 1..20: mol_type = other DNA
ccggtaacattttatttacc

SEQ ID NO: 754 - DNA, 20 bp, synthetic construct
  source 1..20: mol_type = other DNA
tcaatgtattgttgccaaat

SEQ ID NO: 755 - DNA, 20 bp, synthetic construct
  source 1..20: mol_type = other DNA
atgagctacccacacagtca

SEQ ID NO: 756 - DNA, 20 bp, synthetic construct
  source 1..20: mol_type = other DNA
ttggaaggatggagacatcg

SEQ ID NO: 757 - DNA, 20 bp, synthetic construct
  source 1..20: mol_type = other DNA
tgatatggcatgatgtctac

SEQ ID NO: 758 - DNA, 20 bp, synthetic construct
  source 1..20: mol_type = other DNA
agatgatatgctatgacata

SEQ ID NO: 759 - DNA, 20 bp, synthetic construct
  source 1..20: mol_type = other DNA
tgtcctgtctcataacatct

SEQ ID NO: 760 - DNA, 20 bp, synthetic construct
  source 1..20: mol_type = other DNA
agaatatttatgcactaaac

SEQ ID NO: 761 - DNA, 20 bp, synthetic construct
  source 1..20: mol_type = other DNA
gttctaacagcaatttcctt

SEQ ID NO: 762 - DNA, 20 bp, synthetic construct
  source 1..20: mol_type = other DNA
atccttatgtcctcacagat

SEQ ID NO: 763 - DNA, 20 bp, synthetic construct
  source 1..20: mol_type = other DNA
tatttcctctcaatgtttat

SEQ ID NO: 764 - DNA, 20 bp, synthetic construct
  source 1..20: mol_type = other DNA
ttaaaaaaaggaatgggata

SEQ ID NO: 765 - DNA, 20 bp, synthetic construct
  source 1..20: mol_type = other DNA
caacctgaaaaaattagtct

SEQ ID NO: 766 - DNA, 20 bp, synthetic construct
  source 1..20: mol_type = other DNA
ataaatgagttgatcagtgg

SEQ ID NO: 767 - DNA, 20 bp, synthetic construct
  source 1..20: mol_type = other DNA
tattcctggatgagaaaaat

SEQ ID NO: 768 - DNA, 20 bp, synthetic construct
  source 1..20: mol_type = other DNA
cctaagactggttaaaatat

SEQ ID NO: 769 - DNA, 20 bp, synthetic construct
  source 1..20: mol_type = other DNA
ataaggaaagttgttctggg

SEQ ID NO: 770 - DNA, 20 bp, synthetic construct
  source 1..20: mol_type = other DNA
atgcaataacaattatgcac

SEQ ID NO: 771 - DNA, 20 bp, synthetic construct
  source 1..20: mol_type = other DNA
ggagttgatatttcaggtac

SEQ ID NO: 772 - DNA, 20 bp, synthetic construct
  source 1..20: mol_type = other DNA
ttttcagaggatctactgtg

SEQ ID NO: 773 - DNA, 20 bp, synthetic construct
  source 1..20: mol_type = other DNA
taaatgtgaggaaatatttg

SEQ ID NO: 774 - DNA, 20 bp, synthetic construct
  source 1..20: mol_type = other DNA
catatgtatagtccgtgaat

SEQ ID NO: 775 - DNA, 20 bp, synthetic construct
  source 1..20: mol_type = other DNA
tcactgaggaatgtgataaa

SEQ ID NO: 776 - DNA, 20 bp, synthetic construct
  source 1..20: mol_type = other DNA
tttattgacagcttaccagg

SEQ ID NO: 777 - DNA, 20 bp, synthetic construct
  source 1..20: mol_type = other DNA
agcaaaaaacaaaggagtca

SEQ ID NO: 778 - DNA, 20 bp, synthetic construct
  source 1..20: mol_type = other DNA
gagaacagtgagaagtacaa

SEQ ID NO: 779 - DNA, 20 bp, synthetic construct
  source 1..20: mol_type = other DNA
tagagatctgagtcaatttc

SEQ ID NO: 780 - DNA, 20 bp, synthetic construct
  source 1..20: mol_type = other DNA
gctactgtgaaggaaaacat

SEQ ID NO: 781 - DNA, 20 bp, synthetic construct
  source 1..20: mol_type = other DNA
atccaaatgttaaccacata

SEQ ID NO: 782 - DNA, 20 bp, synthetic construct
  source 1..20: mol_type = other DNA
acaggagatacttgttcaga

SEQ ID NO: 783 - DNA, 20 bp, synthetic construct
  source 1..20: mol_type = other DNA
tagaaaatagttccaattag

SEQ ID NO: 784 - DNA, 20 bp, synthetic construct
  source 1..20: mol_type = other DNA
ccttaaaatatttccctttc

SEQ ID NO: 785 - DNA, 20 bp, synthetic construct
  source 1..20: mol_type = other DNA
aaagataattcttttgggaa

SEQ ID NO: 786 - DNA, 20 bp, synthetic construct
  source 1..20: mol_type = other DNA
gtacaaatatgagtatttag

SEQ ID NO: 787 - DNA, 20 bp, synthetic construct
  source 1..20: mol_type = other DNA
gagctcagctcaccgcccgc

SEQ ID NO: 788 - DNA, 20 bp, synthetic construct
  source 1..20: mol_type = other DNA
gccggccacagctccccggg

SEQ ID NO: 789 - DNA, 20 bp, synthetic construct
  source 1..20: mol_type = other DNA
ccgccctcccagcatgaacg

SEQ ID NO: 790 - DNA, 20 bp, synthetic construct
  source 1..20: mol_type = other DNA
tccaacccgccgccctccca

SEQ ID NO: 791 - DNA, 20 bp, synthetic construct
  source 1..20: mol_type = other DNA
tagccatggtggcacctgct

SEQ ID NO: 792 - DNA, 20 bp, synthetic construct
  source 1..20: mol_type = other DNA
agctgccactagccatggtg

SEQ ID NO: 793 - DNA, 20 bp, synthetic construct
  source 1..20: mol_type = other DNA
acccctgacagctgccacta

SEQ ID NO: 794 - DNA, 20 bp, synthetic construct
  source 1..20: mol_type = other DNA
cctcttcgcacccctgacag

SEQ ID NO: 795 - DNA, 20 bp, synthetic construct
  source 1..20: mol_type = other DNA
tatctgttttccttcctgga

SEQ ID NO: 796 - DNA, 20 bp, synthetic construct
  source 1..20: mol_type = other DNA
ctatctgttttccttcctgg

SEQ ID NO: 797 - DNA, 20 bp, synthetic construct
  source 1..20: mol_type = other DNA
tctatctgttttccttcctg

SEQ ID NO: 798 - DNA, 20 bp, synthetic construct
  source 1..20: mol_type = other DNA
ttctatctgttttccttcct

SEQ ID NO: 799 - DNA, 20 bp, synthetic construct
  source 1..20: mol_type = other DNA
tttctatctgttttccttcc

SEQ ID NO: 800 - DNA, 20 bp, synthetic construct
  source 1..20: mol_type = other DNA
cgtttctatctgttttcctt

SEQ ID NO: 801 - DNA, 20 bp, synthetic construct
  source 1..20: mol_type = other DNA
ctccaggatttggaccagcg

SEQ ID NO: 802 - DNA, 20 bp, synthetic construct
  source 1..20: mol_type = other DNA
cagcagatcctccaggattt

SEQ ID NO: 803 - DNA, 20 bp, synthetic construct
  source 1..20: mol_type = other DNA
cgtgaacaccagcagatcct

SEQ ID NO: 804 - DNA, 20 bp, synthetic construct
  source 1..20: mol_type = other DNA
tatttttgccttgaaataac

SEQ ID NO: 805 - DNA, 20 bp, synthetic construct
  source 1..20: mol_type = other DNA
gcacatggatatttttgcct

SEQ ID NO: 806 - DNA, 20 bp, synthetic construct
  source 1..20: mol_type = other DNA
tcaacagaggcacatggata

SEQ ID NO: 807 - DNA, 20 bp, synthetic construct
  source 1..20: mol_type = other DNA
gactctcatataggagtcca

SEQ ID NO: 808 - DNA, 20 bp, synthetic construct
  source 1..20: mol_type = other DNA
cacactcgcgactctcatat

SEQ ID NO: 809 - DNA, 20 bp, synthetic construct
  source 1..20: mol_type = other DNA
cacctgctgcacactcgcga

SEQ ID NO: 810 - DNA, 20 bp, synthetic construct
  source 1..20: mol_type = other DNA
tgaccaacccacctgctgca

SEQ ID NO: 811 - DNA, 20 bp, synthetic construct
  source 1..20: mol_type = other DNA
tctattaatttgcacagaag

SEQ ID NO: 812 - DNA, 20 bp, synthetic construct
  source 1..20: mol_type = other DNA
ggacagacttctattaattt

SEQ ID NO: 813 - DNA, 20 bp, synthetic construct
  source 1..20: mol_type = other DNA
attgtacctggacagacttc

SEQ ID NO: 814 - DNA, 20 bp, synthetic construct
  source 1..20: mol_type = other DNA
atcatttccaacatcctggg

SEQ ID NO: 815 - DNA, 20 bp, synthetic construct
  source 1..20: mol_type = other DNA
gacttcccaatcatttccaa

SEQ ID NO: 816 - DNA, 20 bp, synthetic construct
  source 1..20: mol_type = other DNA
taagaatcaattggtgaaca

SEQ ID NO: 817 - DNA, 20 bp, synthetic construct
  source 1..20: mol_type = other DNA
ttagcattttaagaatcaat

SEQ ID NO: 818 - DNA, 20 bp, synthetic construct
  source 1..20: mol_type = other DNA
attatgaactgttagcattt

SEQ ID NO: 819 - DNA, 20 bp, synthetic construct
  source 1..20: mol_type = other DNA
aatcactgacaagtttacac

SEQ ID NO: 820 - DNA, 20 bp, synthetic construct
  source 1..20: mol_type = other DNA
cttcagtccaatcactgaca

SEQ ID NO: 821 - DNA, 20 bp, synthetic construct
  source 1..20: mol_type = other DNA
atctaaggtcttcagtccaa

SEQ ID NO: 822 - DNA, 20 bp, synthetic construct
  source 1..20: mol_type = other DNA
agttaggaggagatctaagg

SEQ ID NO: 823 - DNA, 20 bp, synthetic construct
  source 1..20: mol_type = other DNA
aagttaggaggagatctaag

SEQ ID NO: 824 - DNA, 20 bp, synthetic construct
  source 1..20: mol_type = other DNA
gaagttaggaggagatctaa

SEQ ID NO: 825 - DNA, 20 bp, synthetic construct
  source 1..20: mol_type = other DNA
tgaagttaggaggagatcta

SEQ ID NO: 826 - DNA, 20 bp, synthetic construct
  source 1..20: mol_type = other DNA
ctgaagttaggaggagatct

SEQ ID NO: 827 - DNA, 20 bp, synthetic construct
  source 1..20: mol_type = other DNA
acctgaagttaggaggagat

SEQ ID NO: 828 - DNA, 20 bp, synthetic construct
  source 1..20: mol_type = other DNA
tacctgaagttaggaggaga

SEQ ID NO: 829 - DNA, 20 bp, synthetic construct
  source 1..20: mol_type = other DNA
ttacctgaagttaggaggag

SEQ ID NO: 830 - DNA, 20 bp, synthetic construct
  source 1..20: mol_type = other DNA
tttacctgaagttaggagga

SEQ ID NO: 831 - DNA, 20 bp, synthetic construct
  source 1..20: mol_type = other DNA
ttttacctgaagttaggagg

SEQ ID NO: 832 - DNA, 20 bp, synthetic construct
  source 1..20: mol_type = other DNA
gtgattttacctgaagttag

SEQ ID NO: 833 - DNA, 20 bp, synthetic construct
  source 1..20: mol_type = other DNA
atcagcaaggtgattttacc

SEQ ID NO: 834 - DNA, 20 bp, synthetic construct
  source 1..20: mol_type = other DNA
tcatccaatatcagcaaggt

SEQ ID NO: 835 - DNA, 20 bp, synthetic construct
  source 1..20: mol_type = other DNA
tcactttcttcatccaatat

SEQ ID NO: 836 - DNA, 20 bp, synthetic construct
  source 1..20: mol_type = other DNA
atggcatcaaaaattaacat

SEQ ID NO: 837 - DNA, 20 bp, synthetic construct
  source 1..20: mol_type = other DNA
catggcatcaaaaattaaca

SEQ ID NO: 838 - DNA, 20 bp, synthetic construct
  source 1..20: mol_type = other DNA
tgcatggcatcaaaaattaa

SEQ ID NO: 839 - DNA, 20 bp, synthetic construct
  source 1..20: mol_type = other DNA
agtgcatggcatcaaaaatt

SEQ ID NO: 840 - DNA, 20 bp, synthetic construct
  source 1..20: mol_type = other DNA
tgagtgcatggcatcaaaaa

SEQ ID NO: 841 - DNA, 20 bp, synthetic construct
  source 1..20: mol_type = other DNA
atgagtgcatggcatcaaaa

SEQ ID NO: 842 - DNA, 20 bp, synthetic construct
  source 1..20: mol_type = other DNA
aaatgagtgcatggcatcaa

SEQ ID NO: 843 - DNA, 20 bp, synthetic construct
  source 1..20: mol_type = other DNA
gaaatgagtgcatggcatca

SEQ ID NO: 844 - DNA, 20 bp, synthetic construct
  source 1..20: mol_type = other DNA
ttggctggaaatgagtgcat

SEQ ID NO: 845 - DNA, 20 bp, synthetic construct
  source 1..20: mol_type = other DNA
agtttctggacttcatcatt

SEQ ID NO: 846 - DNA, 20 bp, synthetic construct
  source 1..20: mol_type = other DNA
ttgcatccaagtttctggac

SEQ ID NO: 847 - DNA, 20 bp, synthetic construct
  source 1..20: mol_type = other DNA
tgtaaagctttgcatccaag

SEQ ID NO: 848 - DNA, 20 bp, synthetic construct
  source 1..20: mol_type = other DNA
cctctgagactctctcaaac

SEQ ID NO: 849 - DNA, 20 bp, synthetic construct
  source 1..20: mol_type = other DNA
tcagttgctcctctgagact

SEQ ID NO: 850 - DNA, 20 bp, synthetic construct
  source 1..20: mol_type = other DNA
caaattcagtcagttgctcc

SEQ ID NO: 851 - DNA, 20 bp, synthetic construct
  source 1..20: mol_type = other DNA
caatatcatataatctttgt

SEQ ID NO: 852 - DNA, 20 bp, synthetic construct
  source 1..20: mol_type = other DNA
cgcacttaacaatatcatat

SEQ ID NO: 853 - DNA, 20 bp, synthetic construct
  source 1..20: mol_type = other DNA
atttgttaacgcacttaaca

SEQ ID NO: 854 - DNA, 20 bp, synthetic construct
  source 1..20: mol_type = other DNA
atctttaaaatttgttaacg

SEQ ID NO: 855 - DNA, 20 bp, synthetic construct
  source 1..20: mol_type = other DNA
tgaagcacaatttcctcttc

SEQ ID NO: 856 - DNA, 20 bp, synthetic construct
  source 1..20: mol_type = other DNA
tgcagcacatgaagcacaat

SEQ ID NO: 857 - DNA, 20 bp, synthetic construct
  source 1..20: mol_type = other DNA
tgtaaacaatgcagcacatg

SEQ ID NO: 858 - DNA, 20 bp, synthetic construct
  source 1..20: mol_type = other DNA
cattattgcaaggaatcgct

SEQ ID NO: 859 - DNA, 20 bp, synthetic construct
  source 1..20: mol_type = other DNA
ggacttccacattattgcaa

SEQ ID NO: 860 - DNA, 20 bp, synthetic construct
  source 1..20: mol_type = other DNA
cactcatgaggacttccaca

SEQ ID NO: 861 - DNA, 20 bp, synthetic construct
  source 1..20: mol_type = other DNA
cacaatattataacacctga

SEQ ID NO: 862 - DNA, 20 bp, synthetic construct
  source 1..20: mol_type = other DNA
tgctttcatagcttccacca

SEQ ID NO: 863 - DNA, 20 bp, synthetic construct
  source 1..20: mol_type = other DNA
atgctttcatagcttccacc

SEQ ID NO: 864 - DNA, 20 bp, synthetic construct
  source 1..20: mol_type = other DNA
gaatgctttcatagcttcca

SEQ ID NO: 865 - DNA, 20 bp, synthetic construct
  source 1..20: mol_type = other DNA
gggaatgctttcatagcttc

SEQ ID NO: 866 - DNA, 20 bp, synthetic construct
  source 1..20: mol_type = other DNA
tagggaatgctttcatagct

SEQ ID NO: 867 - DNA, 20 bp, synthetic construct
  source 1..20: mol_type = other DNA
atagggaatgctttcatagc

SEQ ID NO: 868 - DNA, 20 bp, synthetic construct
  source 1..20: mol_type = other DNA
tcatagggaatgctttcata

SEQ ID NO: 869 - DNA, 20 bp, synthetic construct
  source 1..20: mol_type = other DNA
ctcatagggaatgctttcat

SEQ ID NO: 870 - DNA, 20 bp, synthetic construct
  source 1..20: mol_type = other DNA
actcatagggaatgctttca

SEQ ID NO: 871 - DNA, 20 bp, synthetic construct
  source 1..20: mol_type = other DNA
cactcatagggaatgctttc

SEQ ID NO: 872 - DNA, 20 bp, synthetic construct
  source 1..20: mol_type = other DNA
tcactcatagggaatgcttt

SEQ ID NO: 873 - DNA, 20 bp, synthetic construct
  source 1..20: mol_type = other DNA
ttcactcatagggaatgctt

SEQ ID NO: 874 - DNA, 20 bp, synthetic construct
  source 1..20: mol_type = other DNA
tttcactcatagggaatgct

SEQ ID NO: 875 - DNA, 20 bp, synthetic construct
  source 1..20: mol_type = other DNA
tctttcactcatagggaatg

SEQ ID NO: 876 - DNA, 20 bp, synthetic construct
  source 1..20: mol_type = other DNA
ttctttcactcatagggaat

SEQ ID NO: 877 - DNA, 20 bp, synthetic construct
  source 1..20: mol_type = other DNA
attctttcactcatagggaa

SEQ ID NO: 878 - DNA, 20 bp, synthetic construct
  source 1..20: mol_type = other DNA
aattctttcactcataggga

SEQ ID NO: 879 - DNA, 20 bp, synthetic construct
  source 1..20: mol_type = other DNA
gaattctttcactcataggg

SEQ ID NO: 880 - DNA, 20 bp, synthetic construct
  source 1..20: mol_type = other DNA
tcttgaattctttcactcat

SEQ ID NO: 881 - DNA, 20 bp, synthetic construct
  source 1..20: mol_type = other DNA
gcaactcacttcttgaattc

SEQ ID NO: 882 - DNA, 20 bp, synthetic construct
  source 1..20: mol_type = other DNA
gagcaaacagcaactcactt

SEQ ID NO: 883 - DNA, 20 bp, synthetic construct
  source 1..20: mol_type = other DNA
aaaaattacctaatgtaagc

SEQ ID NO: 884 - DNA, 20 bp, synthetic construct
  source 1..20: mol_type = other DNA
ggatattgaaaaaattacct

SEQ ID NO: 885 - DNA, 20 bp, synthetic construct
  source 1..20: mol_type = other DNA
ttaataccaggatattgaaa

SEQ ID NO: 886 - DNA, 20 bp, synthetic construct
  source 1..20: mol_type = other DNA
accacaaactcatggacttc

SEQ ID NO: 887 - DNA, 20 bp, synthetic construct
  source 1..20: mol_type = other DNA
caccacaaactcatggactt

SEQ ID NO: 888 - DNA, 20 bp, synthetic construct
  source 1..20: mol_type = other DNA
tcaccacaaactcatggact

SEQ ID NO: 889 - DNA, 20 bp, synthetic construct
  source 1..20: mol_type = other DNA
ttcaccacaaactcatggac

SEQ ID NO: 890 - DNA, 20 bp, synthetic construct
  source 1..20: mol_type = other DNA
tttcaccacaaactcatgga

SEQ ID NO: 891 - DNA, 20 bp, synthetic construct
  source 1..20: mol_type = other DNA
acagctttcaccacaaactc

SEQ ID NO: 892 - DNA, 20 bp, synthetic construct
  source 1..20: mol_type = other DNA
tactgctgcacagctttcac

SEQ ID NO: 893 - DNA, 20 bp, synthetic construct
  source 1..20: mol_type = other DNA
ttctctgggtactgctgcac

SEQ ID NO: 894 - DNA, 20 bp, synthetic construct
  source 1..20: mol_type = other DNA
agggccaaacagctgagcgc

SEQ ID NO: 895 - DNA, 20 bp, synthetic construct
  source 1..20: mol_type = other DNA
tcagtgaggagggccaaaca

SEQ ID NO: 896 - DNA, 20 bp, synthetic construct
  source 1..20: mol_type = other DNA
ctaaatcttgatttaagaaa

SEQ ID NO: 897 - DNA, 20 bp, synthetic construct
  source 1..20: mol_type = other DNA
tcttttcctctaaatcttga

SEQ ID NO: 898 - DNA, 20 bp, synthetic construct
  source 1..20: mol_type = other DNA
cttgattctcattcttttcc

SEQ ID NO: 899 - DNA, 20 bp, synthetic construct
  source 1..20: mol_type = other DNA
cttccccctcatcatcattc

SEQ ID NO: 900 - DNA, 20 bp, synthetic construct
  source 1..20: mol_type = other DNA
atttatcttcttccccctca

SEQ ID NO: 901 - DNA, 20 bp, synthetic construct
  source 1..20: mol_type = other DNA
gccaaaacaatttatcttct

SEQ ID NO: 902 - DNA, 20 bp, synthetic construct
  source 1..20: mol_type = other DNA
cgttaatgctttgtaacagg

SEQ ID NO: 903 - DNA, 20 bp, synthetic construct
  source 1..20: mol_type = other DNA
cttgttctttctatgccacg

SEQ ID NO: 904 - DNA, 20 bp, synthetic construct
  source 1..20: mol_type = other DNA
ttagtgcccagcatgcggcc

SEQ ID NO: 905 - DNA, 20 bp, synthetic construct
  source 1..20: mol_type = other DNA
ggagattatttagtgcccag

SEQ ID NO: 906 - DNA, 20 bp, synthetic construct
  source 1..20: mol_type = other DNA
ggtacataaggagattattt

SEQ ID NO: 907 - DNA, 20 bp, synthetic construct
  source 1..20: mol_type = other DNA
tccaatcttctcatgtaaac

SEQ ID NO: 908 - DNA, 20 bp, synthetic construct
  source 1..20: mol_type = other DNA
atcttcatctccaatcttct

SEQ ID NO: 909 - DNA, 20 bp, synthetic construct
  source 1..20: mol_type = other DNA
gaaatggccatcttcatctc

SEQ ID NO: 910 - DNA, 20 bp, synthetic construct
  source 1..20: mol_type = other DNA
gagagcatcacttccctatg

SEQ ID NO: 911 - DNA, 20 bp, synthetic construct
  source 1..20: mol_type = other DNA
atcagcatggagagcatcac

SEQ ID NO: 912 - DNA, 20 bp, synthetic construct
  source 1..20: mol_type = other DNA
gaagaatgcatcagcatgga

SEQ ID NO: 913 - DNA, 20 bp, synthetic construct
  source 1..20: mol_type = other DNA
cagatgcctggaaaacttcc

SEQ ID NO: 914 - DNA, 20 bp, synthetic construct
  source 1..20: mol_type = other DNA
atgcattcgcagatgcctgg

SEQ ID NO: 915 - DNA, 20 bp, synthetic construct
  source 1..20: mol_type = other DNA
gagttgacaatgcattcgca

SEQ ID NO: 916 - DNA, 20 bp, synthetic construct
  source 1..20: mol_type = other DNA
tgttctaagagagttgacaa

SEQ ID NO: 917 - DNA, 20 bp, synthetic construct
  source 1..20: mol_type = other DNA
gtattccttttgataacagt

SEQ ID NO: 918 - DNA, 20 bp, synthetic construct
  source 1..20: mol_type = other DNA
cattcaggtgtattcctttt

SEQ ID NO: 919 - DNA, 20 bp, synthetic construct
  source 1..20: mol_type = other DNA
actccaaaacattcaggtgt

SEQ ID NO: 920 - DNA, 20 bp, synthetic construct
  source 1..20: mol_type = other DNA
aggagaatgtatatgcttct

SEQ ID NO: 921 - DNA, 20 bp, synthetic construct
  source 1..20: mol_type = other DNA
agccacttcaggagaatgta

SEQ ID NO: 922 - DNA, 20 bp, synthetic construct
  source 1..20: mol_type = other DNA
gccactttcagccacttcag

SEQ ID NO: 923 - DNA, 20 bp, synthetic construct
  source 1..20: mol_type = other DNA
tcaaaaagatgatttagcat

SEQ ID NO: 924 - DNA, 20 bp, synthetic construct
  source 1..20: mol_type = other DNA
ttgcttccttcaaaaagatg

SEQ ID NO: 925 - DNA, 20 bp, synthetic construct
  source 1..20: mol_type = other DNA
cagggaagtgttgcttcctt

SEQ ID NO: 926 - DNA, 20 bp, synthetic construct
  source 1..20: mol_type = other DNA
ataactgttagtattttggg

SEQ ID NO: 927 - DNA, 20 bp, synthetic construct
  source 1..20: mol_type = other DNA
agctgcactggtaatgatgt

SEQ ID NO: 928 - DNA, 20 bp, synthetic construct
  source 1..20: mol_type = other DNA
tgtaaaatagctcgaagcgc

SEQ ID NO: 929 - DNA, 20 bp, synthetic construct
  source 1..20: mol_type = other DNA
ctggcatgccaggcactata

SEQ ID NO: 930 - DNA, 20 bp, synthetic construct
  source 1..20: mol_type = other DNA
tggattcttctggcatgcca

SEQ ID NO: 931 - DNA, 20 bp, synthetic construct
  source 1..20: mol_type = other DNA
tatcctccctggattcttct

SEQ ID NO: 932 - DNA, 20 bp, synthetic construct
  source 1..20: mol_type = other DNA
ccatatttagcttatgatga

SEQ ID NO: 933 - DNA, 20 bp, synthetic construct
  source 1..20: mol_type = other DNA
gttttttaaccatatttagc

SEQ ID NO: 934 - DNA, 20 bp, synthetic construct
  source 1..20: mol_type = other DNA
tgaaacactgttttttaacc

SEQ ID NO: 935 - DNA, 20 bp, synthetic construct
  source 1..20: mol_type = other DNA
taggaccagtttgtgaatat

SEQ ID NO: 936 - DNA, 20 bp, synthetic construct
  source 1..20: mol_type = other DNA
caaagctgctaggaccagtt

SEQ ID NO: 937 - DNA, 20 bp, synthetic construct
  source 1..20: mol_type = other DNA
gaacctgttcaaagctgcta

SEQ ID NO: 938 - DNA, 20 bp, synthetic construct
  source 1..20: mol_type = other DNA
atttccaatgaacctgttca

SEQ ID NO: 939 - DNA, 20 bp, synthetic construct
  source 1..20: mol_type = other DNA
ttctgaatcccaggatttcc

SEQ ID NO: 940 - DNA, 20 bp, synthetic construct
  source 1..20: mol_type = other DNA
tttctgaatcccaggatttc

SEQ ID NO: 941 - DNA, 20 bp, synthetic construct
  source 1..20: mol_type = other DNA
catttctgaatcccaggatt

SEQ ID NO: 942 - DNA, 20 bp, synthetic construct
  source 1..20: mol_type = other DNA
acatttctgaatcccaggat

SEQ ID NO: 943 - DNA, 20 bp, synthetic construct
  source 1..20: mol_type = other DNA
ccacatttctgaatcccagg

SEQ ID NO: 944 - DNA, 20 bp, synthetic construct
  source 1..20: mol_type = other DNA
atccacatttctgaatccca

SEQ ID NO: 945 - DNA, 20 bp, synthetic construct
  source 1..20: mol_type = other DNA
taatccacatttctgaatcc

SEQ ID NO: 946 - DNA, 20 bp, synthetic construct
  source 1..20: mol_type = other DNA
agaaattacttttaatccac

SEQ ID NO: 947 - DNA, 20 bp, synthetic construct
  source 1..20: mol_type = other DNA
tacaatagaagaaattactt

SEQ ID NO: 948 - DNA, 20 bp, synthetic construct
  source 1..20: mol_type = other DNA
tctaatgcatcaggaaaatg

SEQ ID NO: 949 - DNA, 20 bp, synthetic construct
  source 1..20: mol_type = other DNA
gataacatctctaatgcatc

SEQ ID NO: 950 - DNA, 20 bp, synthetic construct
  source 1..20: mol_type = other DNA
ccttccagggataacatctc

SEQ ID NO: 951 - DNA, 20 bp, synthetic construct
  source 1..20: mol_type = other DNA
tccatagcaccttccaggga

SEQ ID NO: 952 - DNA, 20 bp, synthetic construct
  source 1..20: mol_type = other DNA
actgaatccatagcaccttc

SEQ ID NO: 953 - DNA, 20 bp, synthetic construct
  source 1..20: mol_type = other DNA
cactgaatccatagcacctt

SEQ ID NO: 954 - DNA, 20 bp, synthetic construct
  source 1..20: mol_type = other DNA
gcactgaatccatagcacct

SEQ ID NO: 955 - DNA, 20 bp, synthetic construct
  source 1..20: mol_type = other DNA
agcactgaatccatagcacc

SEQ ID NO: 956 - DNA, 20 bp, synthetic construct
  source 1..20: mol_type = other DNA
aagcactgaatccatagcac

SEQ ID NO: 957 - DNA, 20 bp, synthetic construct
  source 1..20: mol_type = other DNA
tgaagcactgaatccatagc

SEQ ID NO: 958 - DNA, 20 bp, synthetic construct
  source 1..20: mol_type = other DNA
gtgaagcactgaatccatag

SEQ ID NO: 959 - DNA, 20 bp, synthetic construct
  source 1..20: mol_type = other DNA
tgtgaagcactgaatccata

SEQ ID NO: 960 - DNA, 20 bp, synthetic construct
  source 1..20: mol_type = other DNA
gtgtgaagcactgaatccat

SEQ ID NO: 961 - DNA, 20 bp, synthetic construct
  source 1..20: mol_type = other DNA
tgtgtgaagcactgaatcca

SEQ ID NO: 962 - DNA, 20 bp, synthetic construct
  source 1..20: mol_type = other DNA
gcagtgtgtgaagcactgaa

SEQ ID NO: 963 - DNA, 20 bp, synthetic construct
  source 1..20: mol_type = other DNA
gatacatctgcagtgtgtga

SEQ ID NO: 964 - DNA, 20 bp, synthetic construct
  source 1..20: mol_type = other DNA
ggtcatctggatacatctgc

SEQ ID NO: 965 - DNA, 20 bp, synthetic construct
  source 1..20: mol_type = other DNA
gaatttcttggtcatctgga

SEQ ID NO: 966 - DNA, 20 bp, synthetic construct
  source 1..20: mol_type = other DNA
agacttaaacccagacactg

SEQ ID NO: 967 - DNA, 20 bp, synthetic construct
  source 1..20: mol_type = other DNA
tatcctataagacttaaacc

SEQ ID NO: 968 - DNA, 20 bp, synthetic construct
  source 1..20: mol_type = other DNA
gtaatcaagtatcctataag

SEQ ID NO: 969 - DNA, 20 bp, synthetic construct
  source 1..20: mol_type = other DNA
cagttcctatgaacacattc

SEQ ID NO: 970 - DNA, 20 bp, synthetic construct
  source 1..20: mol_type = other DNA
gcagatgtccagttcctatg

SEQ ID NO: 971 - DNA, 20 bp, synthetic construct
  source 1..20: mol_type = other DNA
tttttgccagcagatgtcca

SEQ ID NO: 972 - DNA, 20 bp, synthetic construct
  source 1..20: mol_type = other DNA
aaaccagaatttttgccagc

SEQ ID NO: 973 - DNA, 20 bp, synthetic construct
  source 1..20: mol_type = other DNA
ttaaatcggtataagctgga

SEQ ID NO: 974 - DNA, 20 bp, synthetic construct
  source 1..20: mol_type = other DNA
gcaacatccttaaatcggta

SEQ ID NO: 975 - DNA, 20 bp, synthetic construct
  source 1..20: mol_type = other DNA
tgtatttcagcaacatcctt

SEQ ID NO: 976 - DNA, 20 bp, synthetic construct
  source 1..20: mol_type = other DNA
ctaagattgtctgaaatcct

SEQ ID NO: 977 - DNA, 20 bp, synthetic construct
  source 1..20: mol_type = other DNA
tgaggattgctaagattgtc

SEQ ID NO: 978 - DNA, 20 bp, synthetic construct
  source 1..20: mol_type = other DNA
ctgacaatttgaggattgct

SEQ ID NO: 979 - DNA, 20 bp, synthetic construct
  source 1..20: mol_type = other DNA
atgcaccagcagcttagaaa

SEQ ID NO: 980 - DNA, 20 bp, synthetic construct
  source 1..20: mol_type = other DNA
aaatgaatgatgcaccagca

SEQ ID NO: 981 - DNA, 20 bp, synthetic construct
  source 1..20: mol_type = other DNA
tactaagtcaaatgaatgat

SEQ ID NO: 982 - DNA, 20 bp, synthetic construct
  source 1..20: mol_type = other DNA
gatattggaagacatttgat

SEQ ID NO: 983 - DNA, 20 bp, synthetic construct
  source 1..20: mol_type = other DNA
ttgttccatgatattggaag

SEQ ID NO: 984 - DNA, 20 bp, synthetic construct
  source 1..20: mol_type = other DNA
tttagaaactgttgatcctt

SEQ ID NO: 985 - DNA, 20 bp, synthetic construct
  source 1..20: mol_type = other DNA
gtttagaaactgttgatcct

SEQ ID NO: 986 - DNA, 20 bp, synthetic construct
  source 1..20: mol_type = other DNA
ggtttagaaactgttgatcc

SEQ ID NO: 987 - DNA, 20 bp, synthetic construct
  source 1..20: mol_type = other DNA
aggtttagaaactgttgatc

SEQ ID NO: 988 - DNA, 20 bp, synthetic construct
  source 1..20: mol_type = other DNA
gaggtttagaaactgttgat

SEQ ID NO: 989 - DNA, 20 bp, synthetic construct
  source 1..20: mol_type = other DNA
cagaggtttagaaactgttg

SEQ ID NO: 990 - DNA, 20 bp, synthetic construct
  source 1..20: mol_type = other DNA
acagaggtttagaaactgtt

SEQ ID NO: 991 - DNA, 20 bp, synthetic construct
  source 1..20: mol_type = other DNA
aacagaggtttagaaactgt

SEQ ID NO: 992 - DNA, 20 bp, synthetic construct
  source 1..20: mol_type = other DNA
caacagaggtttagaaactg

SEQ ID NO: 993 - DNA, 20 bp, synthetic construct
  source 1..20: mol_type = other DNA
gcaacagaggtttagaaact

SEQ ID NO: 994 - DNA, 20 bp, synthetic construct
  source 1..20: mol_type = other DNA
acttgcaacagaggtttaga

SEQ ID NO: 995 - DNA, 20 bp, synthetic construct
  source 1..20: mol_type = other DNA
ttgcaaaacacttgcaacag

SEQ ID NO: 996 - DNA, 20 bp, synthetic construct
  source 1..20: mol_type = other DNA
tagctacttttgcaaaacac

SEQ ID NO: 997 - DNA, 20 bp, synthetic construct
  source 1..20: mol_type = other DNA
catcacattttttaagtaat

SEQ ID NO: 998 - DNA, 20 bp, synthetic construct
  source 1..20: mol_type = other DNA
tctctctagcatcacatttt

SEQ ID NO: 999 - DNA, 20 bp, synthetic construct
  source 1..20: mol_type = other DNA
atcacacgctctctctagca

SEQ ID NO: 1000 - DNA, 20 bp, synthetic construct
  source 1..20: mol_type = other DNA
agaagcaagcattcaaccat

SEQ ID NO: 1001 - DNA, 20 bp, synthetic construct
  source 1..20: mol_type = other DNA
gctcccaatagaagcaagca

SEQ ID NO: 1002 - DNA, 20 bp, synthetic construct
  source 1..20: mol_type = other DNA
tgattggcatctgctcccaa

SEQ ID NO: 1003 - DNA, 20 bp, synthetic construct
  source 1..20: mol_type = other DNA
ttgattggcatctgctccca

SEQ ID NO: 1004 - DNA, 20 bp, synthetic construct
  source 1..20: mol_type = other DNA
cttgattggcatctgctccc

SEQ ID NO: 1005 - DNA, 20 bp, synthetic construct
  source 1..20: mol_type = other DNA
gcttgattggcatctgctcc

SEQ ID NO: 1006 - DNA, 20 bp, synthetic construct
  source 1..20: mol_type = other DNA
tgcttgattggcatctgctc

SEQ ID NO: 1007 - DNA, 20 bp, synthetic construct
  source 1..20: mol_type = other DNA
ctttgcttgattggcatctg

SEQ ID NO: 1008 - DNA, 20 bp, synthetic construct
  source 1..20: mol_type = other DNA
cctttgcttgattggcatct

SEQ ID NO: 1009 - DNA, 20 bp, synthetic construct
  source 1..20: mol_type = other DNA
tcctttgcttgattggcatc

SEQ ID NO: 1010 - DNA, 20 bp, synthetic construct
  source 1..20: mol_type = other DNA
ctcctttgcttgattggcat

SEQ ID NO: 1011 - DNA, 20 bp, synthetic construct
  source 1..20: mol_type = other DNA
atccctcctttgcttgattg

SEQ ID NO: 1012 - DNA, 20 bp, synthetic construct
  source 1..20: mol_type = other DNA
ttaaagaagatccctccttt

SEQ ID NO: 1013 - DNA, 20 bp, synthetic construct
  source 1..20: mol_type = other DNA
cctgacaaattaaagaagat

SEQ ID NO: 1014 - DNA, 20 bp, synthetic construct
  source 1..20: mol_type = other DNA
tctttctcacatacctgaca

SEQ ID NO: 1015 - DNA, 20 bp, synthetic construct
  source 1..20: mol_type = other DNA
ctctttctcacatacctgac

SEQ ID NO: 1016 - DNA, 20 bp, synthetic construct
  source 1..20: mol_type = other DNA
ctctctttctcacatacctg

SEQ ID NO: 1017 - DNA, 20 bp, synthetic construct
  source 1..20: mol_type = other DNA
gactgctctctttctcacat

SEQ ID NO: 1018 - DNA, 20 bp, synthetic construct
  source 1..20: mol_type = other DNA
gggactgctctctttctcac

SEQ ID NO: 1019 - DNA, 20 bp, synthetic construct
  source 1..20: mol_type = other DNA
ttgggactgctctctttctc

SEQ ID NO: 1020 - DNA, 20 bp, synthetic construct
  source 1..20: mol_type = other DNA
tttgggactgctctctttct

SEQ ID NO: 1021 - DNA, 20 bp, synthetic construct
  source 1..20: mol_type = other DNA
aatttgggactgctctcttt

SEQ ID NO: 1022 - DNA, 20 bp, synthetic construct
  source 1..20: mol_type = other DNA
caatttgggactgctctctt

SEQ ID NO: 1023 - DNA, 20 bp, synthetic construct
  source 1..20: mol_type = other DNA
tcagtaagagttccaccaat

SEQ ID NO: 1024 - DNA, 20 bp, synthetic construct
  source 1..20: mol_type = other DNA
tacatcttgttcacgagatc

SEQ ID NO: 1025 - DNA, 20 bp, synthetic construct
  source 1..20: mol_type = other DNA
gatctggctgtcacctttcc

SEQ ID NO: 1026 - DNA, 20 bp, synthetic construct
  source 1..20: mol_type = other DNA
caagctgatgatctggctgt

SEQ ID NO: 1027 - DNA, 20 bp, synthetic construct
  source 1..20: mol_type = other DNA
ccttaagagcaagctgatga

SEQ ID NO: 1028 - DNA, 20 bp, synthetic construct
  source 1..20: mol_type = other DNA
ggccagcctccttaagagca

SEQ ID NO: 1029 - DNA, 20 bp, synthetic construct
  source 1..20: mol_type = other DNA
gctattgttggccacatcca

SEQ ID NO: 1030 - DNA, 20 bp, synthetic construct
  source 1..20: mol_type = other DNA
aaggcaaatgctattgttgg

SEQ ID NO: 1031 - DNA, 20 bp, synthetic construct
  source 1..20: mol_type = other DNA
aaatcctccaaggcaaatgc

SEQ ID NO: 1032 - DNA, 20 bp, synthetic construct
  source 1..20: mol_type = other DNA
caagaaggttcaacttttcc

SEQ ID NO: 1033 - DNA, 20 bp, synthetic construct
  source 1..20: mol_type = other DNA
gtttccttaaattagaagtc

SEQ ID NO: 1034 - DNA, 20 bp, synthetic construct
  source 1..20: mol_type = other DNA
atatttgtttgtttccttaa

SEQ ID NO: 1035 - DNA, 20 bp, synthetic construct
  source 1..20: mol_type = other DNA
gtagatgctatatttgtttg

SEQ ID NO: 1036 - DNA, 20 bp, synthetic construct
  source 1..20: mol_type = other DNA
gatatctgatcaccattctt

SEQ ID NO: 1037 - DNA, 20 bp, synthetic construct
  source 1..20: mol_type = other DNA
ttttcatctgatatctgatc

SEQ ID NO: 1038 - DNA, 20 bp, synthetic construct
  source 1..20: mol_type = other DNA
ccacagcacttttcatctga

SEQ ID NO: 1039 - DNA, 20 bp, synthetic construct
  source 1..20: mol_type = other DNA
ttccttcttccacagcactt

SEQ ID NO: 1040 - DNA, 20 bp, synthetic construct
  source 1..20: mol_type = other DNA
ccatcgctgcctgaggctgt

SEQ ID NO: 1041 - DNA, 20 bp, synthetic construct
  source 1..20: mol_type = other DNA
gaaaaatttccatcgctgcc

SEQ ID NO: 1042 - DNA, 20 bp, synthetic construct
  source 1..20: mol_type = other DNA
acatcttcagaaaaatttcc

SEQ ID NO: 1043 - DNA, 20 bp, synthetic construct
  source 1..20: mol_type = other DNA
aggtccattcatcaaattta

SEQ ID NO: 1044 - DNA, 20 bp, synthetic construct
  source 1..20: mol_type = other DNA
caggaataaaggtccattca

SEQ ID NO: 1045 - DNA, 20 bp, synthetic construct
  source 1..20: mol_type = other DNA
tagaagagtcaggaataaag

SEQ ID NO: 1046 - DNA, 20 bp, synthetic construct
  source 1..20: mol_type = other DNA
acacactgtccatagaagag

SEQ ID NO: 1047 - DNA, 20 bp, synthetic construct
  source 1..20: mol_type = other DNA
aaacacactgtccatagaag

SEQ ID NO: 1048 - DNA, 20 bp, synthetic construct
  source 1..20: mol_type = other DNA
gcaaacacactgtccataga

SEQ ID NO: 1049 - DNA, 20 bp, synthetic construct
  source 1..20: mol_type = other DNA
gagcaaacacactgtccata

SEQ ID NO: 1050 - DNA, 20 bp, synthetic construct
  source 1..20: mol_type = other DNA
tgagcaaacacactgtccat

SEQ ID NO: 1051 - DNA, 20 bp, synthetic construct
  source 1..20: mol_type = other DNA
tttgagcaaacacactgtcc

SEQ ID NO: 1052 - DNA, 20 bp, synthetic construct
  source 1..20: mol_type = other DNA
ctttgagcaaacacactgtc

SEQ ID NO: 1053 - DNA, 20 bp, synthetic construct
  source 1..20: mol_type = other DNA
gtcatcactttgagcaaaca

SEQ ID NO: 1054 - DNA, 20 bp, synthetic construct
  source 1..20: mol_type = other DNA
actatccaggtcatcacttt

SEQ ID NO: 1055 - DNA, 20 bp, synthetic construct
  source 1..20: mol_type = other DNA
acttccttcactatccaggt

SEQ ID NO: 1056 - DNA, 20 bp, synthetic construct
  source 1..20: mol_type = other DNA
tttttcacaagaaatgagcc

SEQ ID NO: 1057 - DNA, 20 bp, synthetic construct
  source 1..20: mol_type = other DNA
ttagatttctttttcacaag

SEQ ID NO: 1058 - DNA, 20 bp, synthetic construct
  source 1..20: mol_type = other DNA
ctaattgaattagatttctt

SEQ ID NO: 1059 - DNA, 20 bp, synthetic construct
  source 1..20: mol_type = other DNA
cggcatctcggtaaaattct

SEQ ID NO: 1060 - DNA, 20 bp, synthetic construct
  source 1..20: mol_type = other DNA
gctgtaatacggcatctcgg

SEQ ID NO: 1061 - DNA, 20 bp, synthetic construct
  source 1..20: mol_type = other DNA
ggaattggaatgtctttgca

SEQ ID NO: 1062 - DNA, 20 bp, synthetic construct
  source 1..20: mol_type = other DNA
gggccccaaggaattggaat

SEQ ID NO: 1063 - DNA, 20 bp, synthetic construct
  source 1..20: mol_type = other DNA
atcaaaaatgggccccaagg

SEQ ID NO: 1064 - DNA, 20 bp, synthetic construct
  source 1..20: mol_type = other DNA
ctttttcgcttcagtaaatc

SEQ ID NO: 1065 - DNA, 20 bp, synthetic construct
  source 1..20: mol_type = other DNA
ataatatttttctttttcgc

SEQ ID NO: 1066 - DNA, 20 bp, synthetic construct
  source 1..20: mol_type = other DNA
catctgaagataatattttt

SEQ ID NO: 1067 - DNA, 20 bp, synthetic construct
  source 1..20: mol_type = other DNA
gaagttttgatgacctgagt

SEQ ID NO: 1068 - DNA, 20 bp, synthetic construct
  source 1..20: mol_type = other DNA
tatgggattgaagttttgat

SEQ ID NO: 1069 - DNA, 20 bp, synthetic construct
  source 1..20: mol_type = other DNA
aatgcctcatatgggattga

SEQ ID NO: 1070 - DNA, 20 bp, synthetic construct
  source 1..20: mol_type = other DNA
tgctgtctgaatgcctcata

SEQ ID NO: 1071 - DNA, 20 bp, synthetic construct
  source 1..20: mol_type = other DNA
cagaagccagagaagaaatg

SEQ ID NO: 1072 - DNA, 20 bp, synthetic construct
  source 1..20: mol_type = other DNA
attctctctcagaagccaga

SEQ ID NO: 1073 - DNA, 20 bp, synthetic construct
  source 1..20: mol_type = other DNA
atgtaatatattctctctca

SEQ ID NO: 1074 - DNA, 20 bp, synthetic construct
  source 1..20: mol_type = other DNA
tagttcatttgctgaaaggt

SEQ ID NO: 1075 - DNA, 20 bp, synthetic construct
  source 1..20: mol_type = other DNA
aatatctcttagttcatttg

SEQ ID NO: 1076 - DNA, 20 bp, synthetic construct
  source 1..20: mol_type = other DNA
tagggcatcaatatctctta

SEQ ID NO: 1077 - DNA, 20 bp, synthetic construct
  source 1..20: mol_type = other DNA
tttctggcttagggcatcaa

SEQ ID NO: 1078 - DNA, 20 bp, synthetic construct
  source 1..20: mol_type = other DNA
atgaacacttatacagcatt

SEQ ID NO: 1079 - DNA, 20 bp, synthetic construct
  source 1..20: mol_type = other DNA
atgctccaaatgaacactta

SEQ ID NO: 1080 - DNA, 20 bp, synthetic construct
  source 1..20: mol_type = other DNA
cttttcaagatgctccaaat

SEQ ID NO: 1081 - DNA, 20 bp, synthetic construct
  source 1..20: mol_type = other DNA
gtgagtgcattctggtgaag

SEQ ID NO: 1082 - DNA, 20 bp, synthetic construct
  source 1..20: mol_type = other DNA
tagctgttgtggaaagctcg

SEQ ID NO: 1083 - DNA, 20 bp, synthetic construct
  source 1..20: mol_type = other DNA
gtgtcaaactcttcagagtt

SEQ ID NO: 1084 - DNA, 20 bp, synthetic construct
  source 1..20: mol_type = other DNA
tgtgtcaaactcttcagagt

SEQ ID NO: 1085 - DNA, 20 bp, synthetic construct
  source 1..20: mol_type = other DNA
atgtgtcaaactcttcagag

SEQ ID NO: 1086 - DNA, 20 bp, synthetic construct
  source 1..20: mol_type = other DNA
aatgtgtcaaactcttcaga

SEQ ID NO: 1087 - DNA, 20 bp, synthetic construct
  source 1..20: mol_type = other DNA
agtccaaatgtgtcaaactc

SEQ ID NO: 1088 - DNA, 20 bp, synthetic construct
  source 1..20: mol_type = other DNA
tactgtgcaagtccaaatgt

SEQ ID NO: 1089 - DNA, 20 bp, synthetic construct
  source 1..20: mol_type = other DNA
taaatttattactgtgcaag

SEQ ID NO: 1090 - DNA, 20 bp, synthetic construct
  source 1..20: mol_type = other DNA
acaaataagaaggaaatgat

SEQ ID NO: 1091 - DNA, 20 bp, synthetic construct
  source 1..20: mol_type = other DNA
tcattttcaacaaataagaa

SEQ ID NO: 1092 - DNA, 20 bp, synthetic construct
  source 1..20: mol_type = other DNA
caatacaactcattttcaac

SEQ ID NO: 1093 - DNA, 20 bp, synthetic construct
  source 1..20: mol_type = other DNA
gtcatttcgagagacatcaa

SEQ ID NO: 1094 - DNA, 20 bp, synthetic construct
  source 1..20: mol_type = other DNA
gggtccaatgtcatttcgag

SEQ ID NO: 1095 - DNA, 20 bp, synthetic construct
  source 1..20: mol_type = other DNA
aaccactgagggtccaatgt

SEQ ID NO: 1096 - DNA, 20 bp, synthetic construct
  source 1..20: mol_type = other DNA
gttggacatttcactgtagg

SEQ ID NO: 1097 - DNA, 20 bp, synthetic construct
  source 1..20: mol_type = other DNA
tgtttcagagttggacattt

SEQ ID NO: 1098 - DNA, 20 bp, synthetic construct
  source 1..20: mol_type = other DNA
aggttaaactgtttcagagt

SEQ ID NO: 1099 - DNA, 20 bp, synthetic construct
  source 1..20: mol_type = other DNA
ttatatgacaggttaaactg

SEQ ID NO: 1100 - DNA, 20 bp, synthetic construct
  source 1..20: mol_type = other DNA
ggtacaaaagacagctggtt

SEQ ID NO: 1101 - DNA, 20 bp, synthetic construct
  source 1..20: mol_type = other DNA
aggttctcaggtacaaaaga

SEQ ID NO: 1102 - DNA, 20 bp, synthetic construct
  source 1..20: mol_type = other DNA
acatcagtgaggttctcagg

SEQ ID NO: 1103 - DNA, 20 bp, synthetic construct
  source 1..20: mol_type = other DNA
aaatgagctgctccagtttc

SEQ ID NO: 1104 - DNA, 20 bp, synthetic construct
  source 1..20: mol_type = other DNA
ttccttctaaaatgagctgc

SEQ ID NO: 1105 - DNA, 20 bp, synthetic construct
  source 1..20: mol_type = other DNA
ctgatattttatttccttct

SEQ ID NO: 1106 - DNA, 20 bp, synthetic construct
  source 1..20: mol_type = other DNA
agcatatccctgatatttta

SEQ ID NO: 1107 - DNA, 20 bp, synthetic construct
  source 1..20: mol_type = other DNA
cagttccttcagtctcaagg

SEQ ID NO: 1108 - DNA, 20 bp, synthetic construct
  source 1..20: mol_type = other DNA
tcagttccttcagtctcaag

SEQ ID NO: 1109 - DNA, 20 bp, synthetic construct
  source 1..20: mol_type = other DNA
ttcagttccttcagtctcaa

SEQ ID NO: 1110 - DNA, 20 bp, synthetic construct
  source 1..20: mol_type = other DNA
cttcagttccttcagtctca

SEQ ID NO: 1111 - DNA, 20 bp, synthetic construct
  source 1..20: mol_type = other DNA
tcttcagttccttcagtctc

SEQ ID NO: 1112 - DNA, 20 bp, synthetic construct
  source 1..20: mol_type = other DNA
ttaaaatcttcagttccttc

SEQ ID NO: 1113 - DNA, 20 bp, synthetic construct
  source 1..20: mol_type = other DNA
tactaaggtttaaaatcttc

SEQ ID NO: 1114 - DNA, 20 bp, synthetic construct
  source 1..20: mol_type = other DNA
tgtggttcttactaaggttt

SEQ ID NO: 1115 - DNA, 20 bp, synthetic construct
  source 1..20: mol_type = other DNA
gaaagttctctgatagggat

SEQ ID NO: 1116 - DNA, 20 bp, synthetic construct
  source 1..20: mol_type = other DNA
aagcctcaagaaagttctct

SEQ ID NO: 1117 - DNA, 20 bp, synthetic construct
  source 1..20: mol_type = other DNA
attcattctggcactgaaac

SEQ ID NO: 1118 - DNA, 20 bp, synthetic construct
  source 1..20: mol_type = other DNA
agcaagaaaattcattctgg

SEQ ID NO: 1119 - DNA, 20 bp, synthetic construct
  source 1..20: mol_type = other DNA
aggcatagcagcaagaaaat

SEQ ID NO: 1120 - DNA, 20 bp, synthetic construct
  source 1..20: mol_type = other DNA
aggattgtcatagaaggagg

SEQ ID NO: 1121 - DNA, 20 bp, synthetic construct
  source 1..20: mol_type = other DNA
gataattttaggattgtcat

SEQ ID NO: 1122 - DNA, 20 bp, synthetic construct
  source 1..20: mol_type = other DNA
tttgttctgagataatttta

SEQ ID NO: 1123 - DNA, 20 bp, synthetic construct
  source 1..20: mol_type = other DNA
aaattgcttctggaatacag

SEQ ID NO: 1124 - DNA, 20 bp, synthetic construct
  source 1..20: mol_type = other DNA
gaagatttaaaattgcttct

SEQ ID NO: 1125 - DNA, 20 bp, synthetic construct
  source 1..20: mol_type = other DNA
gcaagtgtggaagatttaaa

SEQ ID NO: 1126 - DNA, 20 bp, synthetic construct
  source 1..20: mol_type = other DNA
tatctaaagaccgcaagtgt

SEQ ID NO: 1127 - DNA, 20 bp, synthetic construct
  source 1..20: mol_type = other DNA
atatctaaagaccgcaagtg

SEQ ID NO: 1128 - DNA, 20 bp, synthetic construct
  source 1..20: mol_type = other DNA
catatctaaagaccgcaagt

SEQ ID NO: 1129 - DNA, 20 bp, synthetic construct
  source 1..20: mol_type = other DNA
tcatatctaaagaccgcaag

SEQ ID NO: 1130 - DNA, 20 bp, synthetic construct
  source 1..20: mol_type = other DNA
ctcatatctaaagaccgcaa

SEQ ID NO: 1131 - DNA, 20 bp, synthetic construct
  source 1..20: mol_type = other DNA
tgctcatatctaaagaccgc

SEQ ID NO: 1132 - DNA, 20 bp, synthetic construct
  source 1..20: mol_type = other DNA
ctgctcatatctaaagaccg

SEQ ID NO: 1133 - DNA, 20 bp, synthetic construct
  source 1..20: mol_type = other DNA
gctgctcatatctaaagacc

SEQ ID NO: 1134 - DNA, 20 bp, synthetic construct
  source 1..20: mol_type = other DNA
tgctgctcatatctaaagac

SEQ ID NO: 1135 - DNA, 20 bp, synthetic construct
  source 1..20: mol_type = other DNA
ttgctgctcatatctaaaga

SEQ ID NO: 1136 - DNA, 20 bp, synthetic construct
  source 1..20: mol_type = other DNA
atcattgctgctcatatcta

SEQ ID NO: 1137 - DNA, 20 bp, synthetic construct
  source 1..20: mol_type = other DNA
gtactgaatatcattgctgc

SEQ ID NO: 1138 - DNA, 20 bp, synthetic construct
  source 1..20: mol_type = other DNA
acctggtaggtactgaatat

SEQ ID NO: 1139 - DNA, 20 bp, synthetic construct
  source 1..20: mol_type = other DNA
aagttcaaagatttccagtg

SEQ ID NO: 1140 - DNA, 20 bp, synthetic construct
  source 1..20: mol_type = other DNA
agttcccttaagttcaaaga

SEQ ID NO: 1141 - DNA, 20 bp, synthetic construct
  source 1..20: mol_type = other DNA
ctaaataagagttcccttaa

SEQ ID NO: 1142 - DNA, 20 bp, synthetic construct
  source 1..20: mol_type = other DNA
agtccaagatgctgatctga

SEQ ID NO: 1143 - DNA, 20 bp, synthetic construct
  source 1..20: mol_type = other DNA
tttcactcaagtccaagatg

SEQ ID NO: 1144 - DNA, 20 bp, synthetic construct
  source 1..20: mol_type = other DNA
aatatgctttttcactcaag

SEQ ID NO: 1145 - DNA, 20 bp, synthetic construct
  source 1..20: mol_type = other DNA
atgcagtttctctactctag

SEQ ID NO: 1146 - DNA, 20 bp, synthetic construct
  source 1..20: mol_type = other DNA
gtgagaaagatgcagtttct

SEQ ID NO: 1147 - DNA, 20 bp, synthetic construct
  source 1..20: mol_type = other DNA
cagtttattgtgagaaagat

SEQ ID NO: 1148 - DNA, 20 bp, synthetic construct
  source 1..20: mol_type = other DNA
aatctctttcagtttattgt

SEQ ID NO: 1149 - DNA, 20 bp, synthetic construct
  source 1..20: mol_type = other DNA
acagccaatctcaggaggaa

SEQ ID NO: 1150 - DNA, 20 bp, synthetic construct
  source 1..20: mol_type = other DNA
attttcaagacagccaatct

SEQ ID NO: 1151 - DNA, 20 bp, synthetic construct
  source 1..20: mol_type = other DNA
agatgtcagattttcaagac

SEQ ID NO: 1152 - DNA, 20 bp, synthetic construct
  source 1..20: mol_type = other DNA
aaggatcttagttccaagtt

SEQ ID NO: 1153 - DNA, 20 bp, synthetic construct
  source 1..20: mol_type = other DNA
tcattgggaaaggatcttag

SEQ ID NO: 1154 - DNA, 20 bp, synthetic construct
  source 1..20: mol_type = other DNA
cccatattttgcttaatttc

SEQ ID NO: 1155 - DNA, 20 bp, synthetic construct
  source 1..20: mol_type = other DNA
aaggaagatcccatattttg

SEQ ID NO: 1156 - DNA, 20 bp, synthetic construct
  source 1..20: mol_type = other DNA
gttcatccaaaggaagatcc

SEQ ID NO: 1157 - DNA, 20 bp, synthetic construct
  source 1..20: mol_type = other DNA
tatgtttaaaatcaaagtta

SEQ ID NO: 1158 - DNA, 20 bp, synthetic construct
  source 1..20: mol_type = other DNA
tacatcctatatgtttaaaa

SEQ ID NO: 1159 - DNA, 20 bp, synthetic construct
  source 1..20: mol_type = other DNA
ttatgatgtctttggcttta

SEQ ID NO: 1160 - DNA, 20 bp, synthetic construct
  source 1..20: mol_type = other DNA
cttatgatgtctttggcttt

SEQ ID NO: 1161 - DNA, 20 bp, synthetic construct
  source 1..20: mol_type = other DNA
accttatgatgtctttggct

SEQ ID NO: 1162 - DNA, 20 bp, synthetic construct
  source 1..20: mol_type = other DNA
aaaccttatgatgtctttgg

SEQ ID NO: 1163 - DNA, 20 bp, synthetic construct
  source 1..20: mol_type = other DNA
aagaaaccttatgatgtctt

SEQ ID NO: 1164 - DNA, 20 bp, synthetic construct
  source 1..20: mol_type = other DNA
atcgctgttgaagaaacctt

SEQ ID NO: 1165 - DNA, 20 bp, synthetic construct
  source 1..20: mol_type = other DNA
ccttttttaatcgctgttga

SEQ ID NO: 1166 - DNA, 20 bp, synthetic construct
  source 1..20: mol_type = other DNA
aaggcacagccttttttaat

SEQ ID NO: 1167 - DNA, 20 bp, synthetic construct
  source 1..20: mol_type = other DNA
attcggttataaggcacagc

SEQ ID NO: 1168 - DNA, 20 bp, synthetic construct
  source 1..20: mol_type = other DNA
cattcggttataaggcacag

SEQ ID NO: 1169 - DNA, 20 bp, synthetic construct
  source 1..20: mol_type = other DNA
tcattcggttataaggcaca

SEQ ID NO: 1170 - DNA, 20 bp, synthetic construct
  source 1..20: mol_type = other DNA
ttcattcggttataaggcac

SEQ ID NO: 1171 - DNA, 20 bp, synthetic construct
  source 1..20: mol_type = other DNA
tttcattcggttataaggca

SEQ ID NO: 1172 - DNA, 20 bp, synthetic construct
  source 1..20: mol_type = other DNA
agtttcattcggttataagg

SEQ ID NO: 1173 - DNA, 20 bp, synthetic construct
  source 1..20: mol_type = other DNA
aagtttcattcggttataag

SEQ ID NO: 1174 - DNA, 20 bp, synthetic construct
  source 1..20: mol_type = other DNA
taagtttcattcggttataa

SEQ ID NO: 1175 - DNA, 20 bp, synthetic construct
  source 1..20: mol_type = other DNA
ataagtttcattcggttata

SEQ ID NO: 1176 - DNA, 20 bp, synthetic construct
  source 1..20: mol_type = other DNA
cataagtttcattcggttat

SEQ ID NO: 1177 - DNA, 20 bp, synthetic construct
  source 1..20: mol_type = other DNA
caatcataagtttcattcgg

SEQ ID NO: 1178 - DNA, 20 bp, synthetic construct
  source 1..20: mol_type = other DNA
tatttcccacaatcataagt

SEQ ID NO: 1179 - DNA, 20 bp, synthetic construct
  source 1..20: mol_type = other DNA
cactcccagtatttcccaca

SEQ ID NO: 1180 - DNA, 20 bp, synthetic construct
  source 1..20: mol_type = other DNA
taattgctgcaataaggtgg

SEQ ID NO: 1181 - DNA, 20 bp, synthetic construct
  source 1..20: mol_type = other DNA
ggttttcattaattgctgca

SEQ ID NO: 1182 - DNA, 20 bp, synthetic construct
  source 1..20: mol_type = other DNA
tctgatttcttggttttcat

SEQ ID NO: 1183 - DNA, 20 bp, synthetic construct
  source 1..20: mol_type = other DNA
actgtggcactttgcattcc

SEQ ID NO: 1184 - DNA, 20 bp, synthetic construct
  source 1..20: mol_type = other DNA
tctatgccaactgtggcact

SEQ ID NO: 1185 - DNA, 20 bp, synthetic construct
  source 1..20: mol_type = other DNA
tctttcacatctatgccaac

SEQ ID NO: 1186 - DNA, 20 bp, synthetic construct
  source 1..20: mol_type = other DNA
ttttgtctcttatttggata

SEQ ID NO: 1187 - DNA, 20 bp, synthetic construct
  source 1..20: mol_type = other DNA
cgagatctctctttcttttg

SEQ ID NO: 1188 - DNA, 20 bp, synthetic construct
  source 1..20: mol_type = other DNA
catttaggacgagatctctc

SEQ ID NO: 1189 - DNA, 20 bp, synthetic construct
  source 1..20: mol_type = other DNA
acgacctgcaaaatcccaca

SEQ ID NO: 1190 - DNA, 20 bp, synthetic construct
  source 1..20: mol_type = other DNA
agtactatagaattcctcac

SEQ ID NO: 1191 - DNA, 20 bp, synthetic construct
  source 1..20: mol_type = other DNA
atagacagcaaggtacaatg

SEQ ID NO: 1192 - DNA, 20 bp, synthetic construct
  source 1..20: mol_type = other DNA
gctgaggtcatagacagcaa

SEQ ID NO: 1193 - DNA, 20 bp, synthetic construct
  source 1..20: mol_type = other DNA
ctgtcccttgctgaggtcat

SEQ ID NO: 1194 - DNA, 20 bp, synthetic construct
  source 1..20: mol_type = other DNA
caaggcttcatggcatcaac

SEQ ID NO: 1195 - DNA, 20 bp, synthetic construct
  source 1..20: mol_type = other DNA
ttgaagagccaaggcttcat

SEQ ID NO: 1196 - DNA, 20 bp, synthetic construct
  source 1..20: mol_type = other DNA
gcctttatattgaagagcca

SEQ ID NO: 1197 - DNA, 20 bp, synthetic construct
  source 1..20: mol_type = other DNA
tgccaacgagaatcacaggg

SEQ ID NO: 1198 - DNA, 20 bp, synthetic construct
  source 1..20: mol_type = other DNA
ccaaatgtgtgccaacgaga

SEQ ID NO: 1199 - DNA, 20 bp, synthetic construct
  source 1..20: mol_type = other DNA
cagaaacatccaaatgtgtg

SEQ ID NO: 1200 - DNA, 20 bp, synthetic construct
  source 1..20: mol_type = other DNA
ttactcatgcaggctttgcg

SEQ ID NO: 1201 - DNA, 20 bp, synthetic construct
  source 1..20: mol_type = other DNA
ttggtgattttactcatgca

SEQ ID NO: 1202 - DNA, 20 bp, synthetic construct
  source 1..20: mol_type = other DNA
ccctcgcttattcaggagtt

SEQ ID NO: 1203 - DNA, 20 bp, synthetic construct
  source 1..20: mol_type = other DNA
ggcagggaaccctcgcttat

SEQ ID NO: 1204 - DNA, 20 bp, synthetic construct
  source 1..20: mol_type = other DNA
gcatcagattcctcggtggc

SEQ ID NO: 1205 - DNA, 20 bp, synthetic construct
  source 1..20: mol_type = other DNA
tttgccaaagcatcagattc

SEQ ID NO: 1206 - DNA, 20 bp, synthetic construct
  source 1..20: mol_type = other DNA
tcttgaaattaaggctctcg

SEQ ID NO: 1207 - DNA, 20 bp, synthetic construct
  source 1..20: mol_type = other DNA
gatctcggatcttgaaatta

SEQ ID NO: 1208 - DNA, 20 bp, synthetic construct
  source 1..20: mol_type = other DNA
cagctgtccaacaacaagct

SEQ ID NO: 1209 - DNA, 20 bp, synthetic construct
  source 1..20: mol_type = other DNA
gtctggaatcagctgtccaa

SEQ ID NO: 1210 - DNA, 20 bp, synthetic construct
  source 1..20: mol_type = other DNA
tacatagcagtctggaatca

SEQ ID NO: 1211 - DNA, 20 bp, synthetic construct
  source 1..20: mol_type = other DNA
tccgataaaatgattttttc

SEQ ID NO: 1212 - DNA, 20 bp, synthetic construct
  source 1..20: mol_type = other DNA
tttttacgctccgataaaat

SEQ ID NO: 1213 - DNA, 20 bp, synthetic construct
  source 1..20: mol_type = other DNA
attggcacatttttacgctc

SEQ ID NO: 1214 - DNA, 20 bp, synthetic construct
  source 1..20: mol_type = other DNA
gtttccggtcaattacggga

SEQ ID NO: 1215 - DNA, 20 bp, synthetic construct
  source 1..20: mol_type = other DNA
ctcactagttgtaataatcg

SEQ ID NO: 1216 - DNA, 20 bp, synthetic construct
  source 1..20: mol_type = other DNA
ttcatctaactgcagctgat

SEQ ID NO: 1217 - DNA, 20 bp, synthetic construct
  source 1..20: mol_type = other DNA
gaagctcattttcatctaac

SEQ ID NO: 1218 - DNA, 20 bp, synthetic construct
  source 1..20: mol_type = other DNA
actcctgattcatttagaaa

SEQ ID NO: 1219 - DNA, 20 bp, synthetic construct
  source 1..20: mol_type = other DNA
tgaagaaggactcctgattc

SEQ ID NO: 1220 - DNA, 20 bp, synthetic construct
  source 1..20: mol_type = other DNA
tcttgaaaatgaagaaggac

SEQ ID NO: 1221 - DNA, 20 bp, synthetic construct
  source 1..20: mol_type = other DNA
agtgctgggtcttgaaaatg

SEQ ID NO: 1222 - DNA, 20 bp, synthetic construct
  source 1..20: mol_type = other DNA
aagtacaagtcacttaactg

SEQ ID NO: 1223 - DNA, 20 bp, synthetic construct
  source 1..20: mol_type = other DNA
tgtcaaaatctgtgccatga

SEQ ID NO: 1224 - DNA, 20 bp, synthetic construct
  source 1..20: mol_type = other DNA
cactttcactgtcaaaatct

SEQ ID NO: 1225 - DNA, 20 bp, synthetic construct
  source 1..20: mol_type = other DNA
acaaccttccactttcactg

SEQ ID NO: 1226 - DNA, 20 bp, synthetic construct
  source 1..20: mol_type = other DNA
gaaataatgcccttagggtg

SEQ ID NO: 1227 - DNA, 20 bp, synthetic construct
  source 1..20: mol_type = other DNA
tctctacgcgaaataatgcc

SEQ ID NO: 1228 - DNA, 20 bp, synthetic construct
  source 1..20: mol_type = other DNA
ttttccacatctctacgcga

SEQ ID NO: 1229 - DNA, 20 bp, synthetic construct
  source 1..20: mol_type = other DNA
gaaagaaatttttccacatc

SEQ ID NO: 1230 - DNA, 20 bp, synthetic construct
  source 1..20: mol_type = other DNA
tggaaatttccttttttttg

SEQ ID NO: 1231 - DNA, 20 bp, synthetic construct
  source 1..20: mol_type = other DNA
tgtagttctttggaaatttc

SEQ ID NO: 1232 - DNA, 20 bp, synthetic construct
  source 1..20: mol_type = other DNA
actgtgacatgtagttcttt

SEQ ID NO: 1233 - DNA, 20 bp, synthetic construct
  source 1..20: mol_type = other DNA
tggaatttttctaggagctt

SEQ ID NO: 1234 - DNA, 20 bp, synthetic construct
  source 1..20: mol_type = other DNA
caaagcaatctggaattttt

SEQ ID NO: 1235 - DNA, 20 bp, synthetic construct
  source 1..20: mol_type = other DNA
tcctattggcaaagcaatct

SEQ ID NO: 1236 - DNA, 20 bp, synthetic construct
  source 1..20: mol_type = other DNA
atattcttctcctattggca

SEQ ID NO: 1237 - DNA, 20 bp, synthetic construct
  source 1..20: mol_type = other DNA
actgcttggaaccagcaaat

SEQ ID NO: 1238 - DNA, 20 bp, synthetic construct
  source 1..20: mol_type = other DNA
gtcagacaaactgcttggaa

SEQ ID NO: 1239 - DNA, 20 bp, synthetic construct
  source 1..20: mol_type = other DNA
aggcctgtggtcagacaaac

SEQ ID NO: 1240 - DNA, 20 bp, synthetic construct
  source 1..20: mol_type = other DNA
ctctatcacaggcctgtggt

SEQ ID NO: 1241 - DNA, 20 bp, synthetic construct
  source 1..20: mol_type = other DNA
gatgataatttcagagttct

SEQ ID NO: 1242 - DNA, 20 bp, synthetic construct
  source 1..20: mol_type = other DNA
atatagtcggatgataattt

SEQ ID NO: 1243 - DNA, 20 bp, synthetic construct
  source 1..20: mol_type = other DNA
aggcatttcatatagtcgga

SEQ ID NO: 1244 - DNA, 20 bp, synthetic construct
  source 1..20: mol_type = other DNA
ttggaaaataaggcatttca

SEQ ID NO: 1245 - DNA, 20 bp, synthetic construct
  source 1..20: mol_type = other DNA
ttaatcttgaccaaaatccc

SEQ ID NO: 1246 - DNA, 20 bp, synthetic construct
  source 1..20: mol_type = other DNA
atcgattgattaatcttgac

SEQ ID NO: 1247 - DNA, 20 bp, synthetic construct
  source 1..20: mol_type = other DNA
tctcaagtaatcgattgatt

SEQ ID NO: 1248 - DNA, 20 bp, synthetic construct
  source 1..20: mol_type = other DNA
ctccctgaaagcatgtaagg

SEQ ID NO: 1249 - DNA, 20 bp, synthetic construct
  source 1..20: mol_type = other DNA
ctgtttgggcgaagtgctcg

SEQ ID NO: 1250 - DNA, 20 bp, synthetic construct
  source 1..20: mol_type = other DNA
tacattctgtttgggcgaag

SEQ ID NO: 1251 - DNA, 20 bp, synthetic construct
  source 1..20: mol_type = other DNA
atacattctgtttgggcgaa

SEQ ID NO: 1252 - DNA, 20 bp, synthetic construct
  source 1..20: mol_type = other DNA
aatacattctgtttgggcga

SEQ ID NO: 1253 - DNA, 20 bp, synthetic construct
  source 1..20: mol_type = other DNA
caatacattctgtttgggcg

SEQ ID NO: 1254 - DNA, 20 bp, synthetic construct
  source 1..20: mol_type = other DNA
ccaatacattctgtttgggc

SEQ ID NO: 1255 - DNA, 20 bp, synthetic construct
  source 1..20: mol_type = other DNA
cgccaatacattctgtttgg

SEQ ID NO: 1256 - DNA, 20 bp, synthetic construct
  source 1..20: mol_type = other DNA
tcgccaatacattctgtttg

SEQ ID NO: 1257 - DNA, 20 bp, synthetic construct
  source 1..20: mol_type = other DNA
gtcgccaatacattctgttt

SEQ ID NO: 1258 - DNA, 20 bp, synthetic construct
  source 1..20: mol_type = other DNA
tgtcgccaatacattctgtt

SEQ ID NO: 1259 - DNA, 20 bp, synthetic construct
  source 1..20: mol_type = other DNA
ttgtcgccaatacattctgt

SEQ ID NO: 1260 - DNA, 20 bp, synthetic construct
  source 1..20: mol_type = other DNA
tgccttgtcgccaatacatt

SEQ ID NO: 1261 - DNA, 20 bp, synthetic construct
  source 1..20: mol_type = other DNA
ttaagtaaatgccttgtcgc

SEQ ID NO: 1262 - DNA, 20 bp, synthetic construct
  source 1..20: mol_type = other DNA
gagaccaatttaagtaaatg

SEQ ID NO: 1263 - DNA, 20 bp, synthetic construct
  source 1..20: mol_type = other DNA
agatcctaccagacaataag

SEQ ID NO: 1264 - DNA, 20 bp, synthetic construct
  source 1..20: mol_type = other DNA
taagacttcagatcctacca

SEQ ID NO: 1265 - DNA, 20 bp, synthetic construct
  source 1..20: mol_type = other DNA
atgattgtctaagacttcag

SEQ ID NO: 1266 - DNA, 20 bp, synthetic construct
  source 1..20: mol_type = other DNA
actctctggatgattgtcta

SEQ ID NO: 1267 - DNA, 20 bp, synthetic construct
  source 1..20: mol_type = other DNA
ggaactgtaatttttaagaa

SEQ ID NO: 1268 - DNA, 20 bp, synthetic construct
  source 1..20: mol_type = other DNA
ctacaagaaggaactgtaat

SEQ ID NO: 1269 - DNA, 20 bp, synthetic construct
  source 1..20: mol_type = other DNA
cagccttttctacaagaagg

SEQ ID NO: 1270 - DNA, 20 bp, synthetic construct
  source 1..20: mol_type = other DNA
ggtccacaacttggcccaaa

SEQ ID NO: 1271 - DNA, 20 bp, synthetic construct
  source 1..20: mol_type = other DNA
aatcaatgtggtccacaact

SEQ ID NO: 1272 - DNA, 20 bp, synthetic construct
  source 1..20: mol_type = other DNA
ccatgagagaatcaatgtgg

SEQ ID NO: 1273 - DNA, 20 bp, synthetic construct
  source 1..20: mol_type = other DNA
accattcttccatgagagaa

SEQ ID NO: 1274 - DNA, 20 bp, synthetic construct
  source 1..20: mol_type = other DNA
caatctccagcaacccagga

SEQ ID NO: 1275 - DNA, 20 bp, synthetic construct
  source 1..20: mol_type = other DNA
ccacaaatatcaatctccag

SEQ ID NO: 1276 - DNA, 20 bp, synthetic construct
  source 1..20: mol_type = other DNA
tctccttcaccacaaatatc

SEQ ID NO: 1277 - DNA, 20 bp, synthetic construct
  source 1..20: mol_type = other DNA
atttcttcaacagagtttct

SEQ ID NO: 1278 - DNA, 20 bp, synthetic construct
  source 1..20: mol_type = other DNA
catttcttcaacagagtttc

SEQ ID NO: 1279 - DNA, 20 bp, synthetic construct
  source 1..20: mol_type = other DNA
cccatttcttcaacagagtt

SEQ ID NO: 1280 - DNA, 20 bp, synthetic construct
  source 1..20: mol_type = other DNA
tgcccatttcttcaacagag

SEQ ID NO: 1281 - DNA, 20 bp, synthetic construct
  source 1..20: mol_type = other DNA
aatgcccatttcttcaacag

SEQ ID NO: 1282 - DNA, 20 bp, synthetic construct
  source 1..20: mol_type = other DNA
taatgcccatttcttcaaca

SEQ ID NO: 1283 - DNA, 20 bp, synthetic construct
  source 1..20: mol_type = other DNA
taaaactatataatgcccat

SEQ ID NO: 1284 - DNA, 20 bp, synthetic construct
  source 1..20: mol_type = other DNA
caccatcattaaaactatat

SEQ ID NO: 1285 - DNA, 20 bp, synthetic construct
  source 1..20: mol_type = other DNA
atcaagtaagattttttgat

SEQ ID NO: 1286 - DNA, 20 bp, synthetic construct
  source 1..20: mol_type = other DNA
catcaagtcatcaagtaaga

SEQ ID NO: 1287 - DNA, 20 bp, synthetic construct
  source 1..20: mol_type = other DNA
tgctttcttcatcaagtcat

SEQ ID NO: 1288 - DNA, 20 bp, synthetic construct
  source 1..20: mol_type = other DNA
tggatttactaagagatctc

SEQ ID NO: 1289 - DNA, 20 bp, synthetic construct
  source 1..20: mol_type = other DNA
tggttgatctggatttacta

SEQ ID NO: 1290 - DNA, 20 bp, synthetic construct
  source 1..20: mol_type = other DNA
ggtgagccttggttgatctg

SEQ ID NO: 1291 - DNA, 20 bp, synthetic construct
  source 1..20: mol_type = other DNA
cagccaaaatcaagtcaggg

SEQ ID NO: 1292 - DNA, 20 bp, synthetic construct
  source 1..20: mol_type = other DNA
taggcaggtcagccaaaatc

SEQ ID NO: 1293 - DNA, 20 bp, synthetic construct
  source 1..20: mol_type = other DNA
atcattattcaacataatat

SEQ ID NO: 1294 - DNA, 20 bp, synthetic construct
  source 1..20: mol_type = other DNA
ttccaactcatcattattca

SEQ ID NO: 1295 - DNA, 20 bp, synthetic construct
  source 1..20: mol_type = other DNA
ttgttcaaattccaactcat

SEQ ID NO: 1296 - DNA, 20 bp, synthetic construct
  source 1..20: mol_type = other DNA
atcacctaggagaaactctg

SEQ ID NO: 1297 - DNA, 20 bp, synthetic construct
  source 1..20: mol_type = other DNA
aaaactgccatcacctagga

SEQ ID NO: 1298 - DNA, 20 bp, synthetic construct
  source 1..20: mol_type = other DNA
aactgatccaaaactgccat

SEQ ID NO: 1299 - DNA, 20 bp, synthetic construct
  source 1..20: mol_type = other DNA
tcttctccttcataggctgc

SEQ ID NO: 1300 - DNA, 20 bp, synthetic construct
  source 1..20: mol_type = other DNA
acagccacttcttctccttc

SEQ ID NO: 1301 - DNA, 20 bp, synthetic construct
  source 1..20: mol_type = other DNA
acagcctgagtgatgtatgt

SEQ ID NO: 1302 - DNA, 20 bp, synthetic construct
  source 1..20: mol_type = other DNA
cttgtcttaacagcctgagt

SEQ ID NO: 1303 - DNA, 20 bp, synthetic construct
  source 1..20: mol_type = other DNA
ccacaagctcttgtcttaac

SEQ ID NO: 1304 - DNA, 20 bp, synthetic construct
  source 1..20: mol_type = other DNA
agcaaagatatcaaactggg

SEQ ID NO: 1305 - DNA, 20 bp, synthetic construct
  source 1..20: mol_type = other DNA
ccagctgccagcaaagatat

SEQ ID NO: 1306 - DNA, 20 bp, synthetic construct
  source 1..20: mol_type = other DNA
ggacgaatcccagctgccag

SEQ ID NO: 1307 - DNA, 20 bp, synthetic construct
  source 1..20: mol_type = other DNA
ggaggctaactccatcacca

SEQ ID NO: 1308 - DNA, 20 bp, synthetic construct
  source 1..20: mol_type = other DNA
ggaacccttggaggctaact

SEQ ID NO: 1309 - DNA, 20 bp, synthetic construct
  source 1..20: mol_type = other DNA
gcgatccaaggaacccttgg

SEQ ID NO: 1310 - DNA, 20 bp, synthetic construct
  source 1..20: mol_type = other DNA
aggctggctttgtcctgctg

SEQ ID NO: 1311 - DNA, 20 bp, synthetic construct
  source 1..20: mol_type = other DNA
gttctagtgaggctggcttt

SEQ ID NO: 1312 - DNA, 20 bp, synthetic construct
  source 1..20: mol_type = other DNA
tgctgtagggttctagtgag

SEQ ID NO: 1313 - DNA, 20 bp, synthetic construct
  source 1..20: mol_type = other DNA
atctcaaaccatcagctacg

SEQ ID NO: 1314 - DNA, 20 bp, synthetic construct
  source 1..20: mol_type = other DNA
agtggaggtatctcaaacca

SEQ ID NO: 1315 - DNA, 20 bp, synthetic construct
  source 1..20: mol_type = other DNA
caggtctcggtatataatca

SEQ ID NO: 1316 - DNA, 20 bp, synthetic construct
  source 1..20: mol_type = other DNA
gaaaagcagcacattgtggg

SEQ ID NO: 1317 - DNA, 20 bp, synthetic construct
  source 1..20: mol_type = other DNA
gcagcattgggatacagtgt

SEQ ID NO: 1318 - DNA, 20 bp, synthetic construct
  source 1..20: mol_type = other DNA
gcaatgatggcagcattggg

SEQ ID NO: 1319 - DNA, 20 bp, synthetic construct
  source 1..20: mol_type = other DNA
tatccccattctacagcagt

SEQ ID NO: 1320 - DNA, 20 bp, synthetic construct
  source 1..20: mol_type = other DNA
tgatgtttttatccccattc

SEQ ID NO: 1321 - DNA, 20 bp, synthetic construct
  source 1..20: mol_type = other DNA
cacgaaaccctggtgtgccc

SEQ ID NO: 1322 - DNA, 20 bp, synthetic construct
  source 1..20: mol_type = other DNA
cttcaggtgcacgaaaccct

SEQ ID NO: 1323 - DNA, 20 bp, synthetic construct
  source 1..20: mol_type = other DNA
ctctggcaacttcaggtgca

SEQ ID NO: 1324 - DNA, 20 bp, synthetic construct
  source 1..20: mol_type = other DNA
agcctgttggttataaatga

SEQ ID NO: 1325 - DNA, 20 bp, synthetic construct
  source 1..20: mol_type = other DNA
ataaacatcagcctgttggt

SEQ ID NO: 1326 - DNA, 20 bp, synthetic construct
  source 1..20: mol_type = other DNA
accaaatgaataaacatcag

SEQ ID NO: 1327 - DNA, 20 bp, synthetic construct
  source 1..20: mol_type = other DNA
gttgtcaaaatgtcatagag

SEQ ID NO: 1328 - DNA, 20 bp, synthetic construct
  source 1..20: mol_type = other DNA
ctacctccagttgtcaaaat

SEQ ID NO: 1329 - DNA, 20 bp, synthetic construct
  source 1..20: mol_type = other DNA
tctactattctacctccagt

SEQ ID NO: 1330 - DNA, 20 bp, synthetic construct
  source 1..20: mol_type = other DNA
ttcaaaccctctactattct

SEQ ID NO: 1331 - DNA, 20 bp, synthetic construct
  source 1..20: mol_type = other DNA
atcaaactcatttggaaact

SEQ ID NO: 1332 - DNA, 20 bp, synthetic construct
  source 1..20: mol_type = other DNA
ttctaattcatcaaactcat

SEQ ID NO: 1333 - DNA, 20 bp, synthetic construct
  source 1..20: mol_type = other DNA
tccttgtatttctaattcat

SEQ ID NO: 1334 - DNA, 20 bp, synthetic construct
  source 1..20: mol_type = other DNA
tattctttaactggatcagg

SEQ ID NO: 1335 - DNA, 20 bp, synthetic construct
  source 1..20: mol_type = other DNA
gcacaaccatattctttaac

SEQ ID NO: 1336 - DNA, 20 bp, synthetic construct
  source 1..20: mol_type = other DNA
actgtttaattaatttctca

SEQ ID NO: 1337 - DNA, 20 bp, synthetic construct
  source 1..20: mol_type = other DNA
ctttcaaacactgtttaatt

SEQ ID NO: 1338 - DNA, 20 bp, synthetic construct
  source 1..20: mol_type = other DNA
gaggattttctttcaaacac

SEQ ID NO: 1339 - DNA, 20 bp, synthetic construct
  source 1..20: mol_type = other DNA
gacctgggcagaagtaggcc

SEQ ID NO: 1340 - DNA, 20 bp, synthetic construct
  source 1..20: mol_type = other DNA
aatgtcaaagacctgggcag

SEQ ID NO: 1341 - DNA, 20 bp, synthetic construct
  source 1..20: mol_type = other DNA
tgaattcaaaatgtcaaaga

SEQ ID NO: 1342 - DNA, 20 bp, synthetic construct
  source 1..20: mol_type = other DNA
tttttaggtaataaaatgcg

SEQ ID NO: 1343 - DNA, 20 bp, synthetic construct
  source 1..20: mol_type = other DNA
gtgtagcaaccatgcattca

SEQ ID NO: 1344 - DNA, 20 bp, synthetic construct
  source 1..20: mol_type = other DNA
cattcctgctgttgtgatgt

SEQ ID NO: 1345 - DNA, 20 bp, synthetic construct
  source 1..20: mol_type = other DNA
gccaaatgcttgcattcctg

SEQ ID NO: 1346 - DNA, 20 bp, synthetic construct
  source 1..20: mol_type = other DNA
agccaaatgcttgcattcct

SEQ ID NO: 1347 - DNA, 20 bp, synthetic construct
  source 1..20: mol_type = other DNA
cagccaaatgcttgcattcc

SEQ ID NO: 1348 - DNA, 20 bp, synthetic construct
  source 1..20: mol_type = other DNA
ccagccaaatgcttgcattc

SEQ ID NO: 1349 - DNA, 20 bp, synthetic construct
  source 1..20: mol_type = other DNA
cccagccaaatgcttgcatt

SEQ ID NO: 1350 - DNA, 20 bp, synthetic construct
  source 1..20: mol_type = other DNA
cagcccagccaaatgcttgc

SEQ ID NO: 1351 - DNA, 20 bp, synthetic construct
  source 1..20: mol_type = other DNA
acagcccagccaaatgcttg

SEQ ID NO: 1352 - DNA, 20 bp, synthetic construct
  source 1..20: mol_type = other DNA
cacagcccagccaaatgctt

SEQ ID NO: 1353 - DNA, 20 bp, synthetic construct
  source 1..20: mol_type = other DNA
ccacagcccagccaaatgct

SEQ ID NO: 1354 - DNA, 20 bp, synthetic construct
  source 1..20: mol_type = other DNA
gtgcccacagcccagccaaa

SEQ ID NO: 1355 - DNA, 20 bp, synthetic construct
  source 1..20: mol_type = other DNA
tctgtcggtgtgcccacagc

SEQ ID NO: 1356 - DNA, 20 bp, synthetic construct
  source 1..20: mol_type = other DNA
gagctgtcctctgtcggtgt

SEQ ID NO: 1357 - DNA, 20 bp, synthetic construct
  source 1..20: mol_type = other DNA
ccttcagtatttaagtcaag

SEQ ID NO: 1358 - DNA, 20 bp, synthetic construct
  source 1..20: mol_type = other DNA
gaagtgtatccttcagtatt

SEQ ID NO: 1359 - DNA, 20 bp, synthetic construct
  source 1..20: mol_type = other DNA
acttcctcagaagtgtatcc

SEQ ID NO: 1360 - DNA, 20 bp, synthetic construct
  source 1..20: mol_type = other DNA
ctaagcacaatattctacta

SEQ ID NO: 1361 - DNA, 20 bp, synthetic construct
  source 1..20: mol_type = other DNA
gcaccaaggctaagcacaat

SEQ ID NO: 1362 - DNA, 20 bp, synthetic construct
  source 1..20: mol_type = other DNA
caggaagatgcaccaaggct

SEQ ID NO: 1363 - DNA, 20 bp, synthetic construct
  source 1..20: mol_type = other DNA
agacacaatccagctttcct

SEQ ID NO: 1364 - DNA, 20 bp, synthetic construct
  source 1..20: mol_type = other DNA
ctgtgtcccagacacaatcc

SEQ ID NO: 1365 - DNA, 20 bp, synthetic construct
  source 1..20: mol_type = other DNA
agtaccagactgtgtcccag

SEQ ID NO: 1366 - DNA, 20 bp, synthetic construct
  source 1..20: mol_type = other DNA
ccatcttcggtattgatgac

SEQ ID NO: 1367 - DNA, 20 bp, synthetic construct
  source 1..20: mol_type = other DNA
ctctttttcccatcttcggt

SEQ ID NO: 1368 - DNA, 20 bp, synthetic construct
  source 1..20: mol_type = other DNA
agggtatgtctctttttccc

SEQ ID NO: 1369 - DNA, 20 bp, synthetic construct
  source 1..20: mol_type = other DNA
aatacaaacaagtgacagaa

SEQ ID NO: 1370 - DNA, 20 bp, synthetic construct
  source 1..20: mol_type = other DNA
ggaaaaggaattgcaataca

SEQ ID NO: 1371 - DNA, 20 bp, synthetic construct
  source 1..20: mol_type = other DNA
gttccaaccaaaagaaaatt

SEQ ID NO: 1372 - DNA, 20 bp, synthetic construct
  source 1..20: mol_type = other DNA
ccatcagcggttccaaccaa

SEQ ID NO: 1373 - DNA, 20 bp, synthetic construct
  source 1..20: mol_type = other DNA
tcaaaaattgctaacttgcc

SEQ ID NO: 1374 - DNA, 20 bp, synthetic construct
  source 1..20: mol_type = other DNA
gtcttatcttcaaaaattgc

SEQ ID NO: 1375 - DNA, 20 bp, synthetic construct
  source 1..20: mol_type = other DNA
agcttaacagtcttatcttc

SEQ ID NO: 1376 - DNA, 20 bp, synthetic construct
  source 1..20: mol_type = other DNA
gtatcttcaaaggagcagct

SEQ ID NO: 1377 - DNA, 20 bp, synthetic construct
  source 1..20: mol_type = other DNA
cctatatttagtatcttcaa

SEQ ID NO: 1378 - DNA, 20 bp, synthetic construct
  source 1..20: mol_type = other DNA
ctgacatttcctatatttag

SEQ ID NO: 1379 - DNA, 20 bp, synthetic construct
  source 1..20: mol_type = other DNA
ttcactcaaacacatcaatg

SEQ ID NO: 1380 - DNA, 20 bp, synthetic construct
  source 1..20: mol_type = other DNA
atttgtggattcactcaaac

SEQ ID NO: 1381 - DNA, 20 bp, synthetic construct
  source 1..20: mol_type = other DNA
ttccgttgaatttgtggatt

SEQ ID NO: 1382 - DNA, 20 bp, synthetic construct
  source 1..20: mol_type = other DNA
ccacatcctccccacattac

SEQ ID NO: 1383 - DNA, 20 bp, synthetic construct
  source 1..20: mol_type = other DNA
atctttgtgccacatcctcc

SEQ ID NO: 1384 - DNA, 20 bp, synthetic construct
  source 1..20: mol_type = other DNA
cattagaaaaggagaaaatc

SEQ ID NO: 1385 - DNA, 20 bp, synthetic construct
  source 1..20: mol_type = other DNA
gtttctgaatggtgaaatca

SEQ ID NO: 1386 - DNA, 20 bp, synthetic construct
  source 1..20: mol_type = other DNA
tctcaatgagtttctgaatg

SEQ ID NO: 1387 - DNA, 20 bp, synthetic construct
  source 1..20: mol_type = other DNA
ttgttcttgtctcaatgagt

SEQ ID NO: 1388 - DNA, 20 bp, synthetic construct
  source 1..20: mol_type = other DNA
acagttggcttgttcttgtc

SEQ ID NO: 1389 - DNA, 20 bp, synthetic construct
  source 1..20: mol_type = other DNA
tgaaagctgcataagaaaac

SEQ ID NO: 1390 - DNA, 20 bp, synthetic construct
  source 1..20: mol_type = other DNA
tggaatcactgaaagctgca

SEQ ID NO: 1391 - DNA, 20 bp, synthetic construct
  source 1..20: mol_type = other DNA
ttatgatgttggaatcactg

SEQ ID NO: 1392 - DNA, 20 bp, synthetic construct
  source 1..20: mol_type = other DNA
atagagagcagtgtctacca

SEQ ID NO: 1393 - DNA, 20 bp, synthetic construct
  source 1..20: mol_type = other DNA
cttagcaatatagagagcag

SEQ ID NO: 1394 - DNA, 20 bp, synthetic construct
  source 1..20: mol_type = other DNA
gctattttgcttagcaatat

SEQ ID NO: 1395 - DNA, 20 bp, synthetic construct
  source 1..20: mol_type = other DNA
ttcttatcccacacttccac

SEQ ID NO: 1396 - DNA, 20 bp, synthetic construct
  source 1..20: mol_type = other DNA
tttttcagttttcttatccc

SEQ ID NO: 1397 - DNA, 20 bp, synthetic construct
  source 1..20: mol_type = other DNA
tccacagagtttttcagttt

SEQ ID NO: 1398 - DNA, 20 bp, synthetic construct
  source 1..20: mol_type = other DNA
ttaaaaagtgcacgcagtct

SEQ ID NO: 1399 - DNA, 20 bp, synthetic construct
  source 1..20: mol_type = other DNA
ttacctcccttaaaaagtgc

SEQ ID NO: 1400 - DNA, 20 bp, synthetic construct
  source 1..20: mol_type = other DNA
cttttaccattacctccctt

SEQ ID NO: 1401 - DNA, 20 bp, synthetic construct
  source 1..20: mol_type = other DNA
ccttgttttcttttaccatt

SEQ ID NO: 1402 - DNA, 20 bp, synthetic construct
  source 1..20: mol_type = other DNA
tcccagaataagacattttg

SEQ ID NO: 1403 - DNA, 20 bp, synthetic construct
  source 1..20: mol_type = other DNA
ttttcactctcccagaataa

SEQ ID NO: 1404 - DNA, 20 bp, synthetic construct
  source 1..20: mol_type = other DNA
agtgttcttctgaaggcaga

SEQ ID NO: 1405 - DNA, 20 bp, synthetic construct
  source 1..20: mol_type = other DNA
ccaaagagcagtgttcttct

SEQ ID NO: 1406 - DNA, 20 bp, synthetic construct
  source 1..20: mol_type = other DNA
agttcctatccaaagagcag

SEQ ID NO: 1407 - DNA, 20 bp, synthetic construct
  source 1..20: mol_type = other DNA
tccaggagtaaaatatggcc

SEQ ID NO: 1408 - DNA, 20 bp, synthetic construct
  source 1..20: mol_type = other DNA
gttgaaagatccaggagtaa

SEQ ID NO: 1409 - DNA, 20 bp, synthetic construct
  source 1..20: mol_type = other DNA
agtcgacgagttgaaagatc

SEQ ID NO: 1410 - DNA, 20 bp, synthetic construct
  source 1..20: mol_type = other DNA
accgaattacaaaagttgta

SEQ ID NO: 1411 - DNA, 20 bp, synthetic construct
  source 1..20: mol_type = other DNA
atgactctgaccgaattaca

SEQ ID NO: 1412 - DNA, 20 bp, synthetic construct
  source 1..20: mol_type = other DNA
gctgtcatcatgactctgac

SEQ ID NO: 1413 - DNA, 20 bp, synthetic construct
  source 1..20: mol_type = other DNA
tgacatttttaaggcttcct

SEQ ID NO: 1414 - DNA, 20 bp, synthetic construct
  source 1..20: mol_type = other DNA
ccaataccagcatgacattt

SEQ ID NO: 1415 - DNA, 20 bp, synthetic construct
  source 1..20: mol_type = other DNA
ggttgtagcccaataccagc

SEQ ID NO: 1416 - DNA, 20 bp, synthetic construct
  source 1..20: mol_type = other DNA
ttgtgtaccttcagtatttt

SEQ ID NO: 1417 - DNA, 20 bp, synthetic construct
  source 1..20: mol_type = other DNA
ctttctgcttttgtgtacct

SEQ ID NO: 1418 - DNA, 20 bp, synthetic construct
  source 1..20: mol_type = other DNA
attgtatctctttctgcttt

SEQ ID NO: 1419 - DNA, 20 bp, synthetic construct
  source 1..20: mol_type = other DNA
ttgatgtcccaaacggtcaa

SEQ ID NO: 1420 - DNA, 20 bp, synthetic construct
  source 1..20: mol_type = other DNA
tgtggaagattgatgtccca

SEQ ID NO: 1421 - DNA, 20 bp, synthetic construct
  source 1..20: mol_type = other DNA
tgcacttcatgtggaagatt

SEQ ID NO: 1422 - DNA, 20 bp, synthetic construct
  source 1..20: mol_type = other DNA
tctaaattttgcacttcatg

SEQ ID NO: 1423 - DNA, 20 bp, synthetic construct
  source 1..20: mol_type = other DNA
ttctcacttcaatgtgtttt

SEQ ID NO: 1424 - DNA, 20 bp, synthetic construct
  source 1..20: mol_type = other DNA
ctaattcttttctcacttca

SEQ ID NO: 1425 - DNA, 20 bp, synthetic construct
  source 1..20: mol_type = other DNA
tcattttttcagctaattct

SEQ ID NO: 1426 - DNA, 20 bp, synthetic construct
  source 1..20: mol_type = other DNA
ctatttctctcttactcaac

SEQ ID NO: 1427 - DNA, 20 bp, synthetic construct
  source 1..20: mol_type = other DNA
agacaattcctatttctctc

SEQ ID NO: 1428 - DNA, 20 bp, synthetic construct
  source 1..20: mol_type = other DNA
ttcctatccaaagacaattc

SEQ ID NO: 1429 - DNA, 20 bp, synthetic construct
  source 1..20: mol_type = other DNA
tatttacaagaggagagaat

SEQ ID NO: 1430 - DNA, 20 bp, synthetic construct
  source 1..20: mol_type = other DNA
ccctttccatgtgaacattt

SEQ ID NO: 1431 - DNA, 20 bp, synthetic construct
  source 1..20: mol_type = other DNA
accctttccatgtgaacatt

SEQ ID NO: 1432 - DNA, 20 bp, synthetic construct
  source 1..20: mol_type = other DNA
taccctttccatgtgaacat

SEQ ID NO: 1433 - DNA, 20 bp, synthetic construct
  source 1..20: mol_type = other DNA
gtaccctttccatgtgaaca

SEQ ID NO: 1434 - DNA, 20 bp, synthetic construct
  source 1..20: mol_type = other DNA
agtaccctttccatgtgaac

SEQ ID NO: 1435 - DNA, 20 bp, synthetic construct
  source 1..20: mol_type = other DNA
tgagtaccctttccatgtga

SEQ ID NO: 1436 - DNA, 20 bp, synthetic construct
  source 1..20: mol_type = other DNA
gtgagtaccctttccatgtg

SEQ ID NO: 1437 - DNA, 20 bp, synthetic construct
  source 1..20: mol_type = other DNA
tgtgagtaccctttccatgt

SEQ ID NO: 1438 - DNA, 20 bp, synthetic construct
  source 1..20: mol_type = other DNA
atgtgagtaccctttccatg

SEQ ID NO: 1439 - DNA, 20 bp, synthetic construct
  source 1..20: mol_type = other DNA
aatgtgagtaccctttccat

SEQ ID NO: 1440 - DNA, 20 bp, synthetic construct
  source 1..20: mol_type = other DNA
aaaaaatgtgagtacccttt

SEQ ID NO: 1441 - DNA, 20 bp, synthetic construct
  source 1..20: mol_type = other DNA
agctatttcaaaaaatgtga

SEQ ID NO: 1442 - DNA, 20 bp, synthetic construct
  source 1..20: mol_type = other DNA
atacacacgagctatttcaa

SEQ ID NO: 1443 - DNA, 20 bp, synthetic construct
  source 1..20: mol_type = other DNA
cattccttcatacacacgag

SEQ ID NO: 1444 - DNA, 20 bp, synthetic construct
  source 1..20: mol_type = other DNA
gtaagtatttttacatatat

SEQ ID NO: 1445 - DNA, 20 bp, synthetic construct
  source 1..20: mol_type = other DNA
tagttctttaaaatacacat

SEQ ID NO: 1446 - DNA, 20 bp, synthetic construct
  source 1..20: mol_type = other DNA
ttgtgttttaaatagttctt

SEQ ID NO: 1447 - DNA, 20 bp, synthetic construct
  source 1..20: mol_type = other DNA
aatataacattgtgttttaa

SEQ ID NO: 1448 - DNA, 20 bp, synthetic construct
  source 1..20: mol_type = other DNA
cgaaagtaactggtatttat

SEQ ID NO: 1449 - DNA, 20 bp, synthetic construct
  source 1..20: mol_type = other DNA
attaatgaacgaaagtaact

SEQ ID NO: 1450 - DNA, 20 bp, synthetic construct
  source 1..20: mol_type = other DNA
ttttcattaattaatgaacg

SEQ ID NO: 1451 - DNA, 20 bp, synthetic construct
  source 1..20: mol_type = other DNA
acagatttattttcattaat

SEQ ID NO: 1452 - DNA, 20 bp, synthetic construct
  source 1..20: mol_type = other DNA
agtacttaaattaggtactt

SEQ ID NO: 1453 - DNA, 20 bp, synthetic construct
  source 1..20: mol_type = other DNA
tttagtatgagtacttaaat

SEQ ID NO: 1454 - DNA, 20 bp, synthetic construct
  source 1..20: mol_type = other DNA
cttataaattttagtatgag

SEQ ID NO: 1455 - DNA, 20 bp, synthetic construct
  source 1..20: mol_type = other DNA
cattacagacaagaaaacaa

SEQ ID NO: 1456 - DNA, 20 bp, synthetic construct
  source 1..20: mol_type = other DNA
gtttacctccattacagaca

SEQ ID NO: 1457 - DNA, 20 bp, synthetic construct
  source 1..20: mol_type = other DNA
taaaataaagtttacctcca

SEQ ID NO: 1458 - DNA, 20 bp, synthetic construct
  source 1..20: mol_type = other DNA
tagtcctgtcttaagcacag

SEQ ID NO: 1459 - DNA, 20 bp, synthetic construct
  source 1..20: mol_type = other DNA
gacaagcaatagtcctgtct

SEQ ID NO: 1460 - DNA, 20 bp, synthetic construct
  source 1..20: mol_type = other DNA
agaaaaatcgacaagcaata

SEQ ID NO: 1461 - DNA, 20 bp, synthetic construct
  source 1..20: mol_type = other DNA
attttcattataccgtgcag

SEQ ID NO: 1462 - DNA, 20 bp, synthetic construct
  source 1..20: mol_type = other DNA
actgtcttaatattttcatt

SEQ ID NO: 1463 - DNA, 20 bp, synthetic construct
  source 1..20: mol_type = other DNA
acatgggaaactgtcttaat

SEQ ID NO: 1464 - DNA, 20 bp, synthetic construct
  source 1..20: mol_type = other DNA
atgcaatctaagaaggaata

SEQ ID NO: 1465 - DNA, 20 bp, synthetic construct
  source 1..20: mol_type = other DNA
tgcatttcgatgcaatctaa

SEQ ID NO: 1466 - DNA, 20 bp, synthetic construct
  source 1..20: mol_type = other DNA
atatgatagtgcatttcgat

SEQ ID NO: 1467 - DNA, 20 bp, synthetic construct
  source 1..20: mol_type = other DNA
tacaagcatatatgatagtg

SEQ ID NO: 1468 - DNA, 20 bp, synthetic construct
  source 1..20: mol_type = other DNA
gactttattagtgcaaattc

SEQ ID NO: 1469 - DNA, 20 bp, synthetic construct
  source 1..20: mol_type = other DNA
ggactttattagtgcaaatt

SEQ ID NO: 1470 - DNA, 20 bp, synthetic construct
  source 1..20: mol_type = other DNA
aggactttattagtgcaaat

SEQ ID NO: 1471 - DNA, 20 bp, synthetic construct
  source 1..20: mol_type = other DNA
aaggactttattagtgcaaa

SEQ ID NO: 1472 - DNA, 20 bp, synthetic construct
  source 1..20: mol_type = other DNA
caaaggactttattagtgca

SEQ ID NO: 1473 - DNA, 20 bp, synthetic construct
  source 1..20: mol_type = other DNA
acaaaggactttattagtgc

SEQ ID NO: 1474 - DNA, 20 bp, synthetic construct
  source 1..20: mol_type = other DNA
aacaaaggactttattagtg

SEQ ID NO: 1475 - DNA, 20 bp, synthetic construct
  source 1..20: mol_type = other DNA
caacaaaggactttattagt

SEQ ID NO: 1476 - DNA, 20 bp, synthetic construct
  source 1..20: mol_type = other DNA
acagcaacaaagagaattca

SEQ ID NO: 1477 - DNA, 20 bp, synthetic construct
  source 1..20: mol_type = other DNA
gcactgtttgcaacagcaac

SEQ ID NO: 1478 - DNA, 20 bp, synthetic construct
  source 1..20: mol_type = other DNA
gtgtaagatgcactgtttgc

SEQ ID NO: 1479 - DNA, 20 bp, synthetic construct
  source 1..20: mol_type = other DNA
tttcttttgaattgagtgaa

SEQ ID NO: 1480 - DNA, 20 bp, synthetic construct
  source 1..20: mol_type = other DNA
taatggagttttcttttgaa

SEQ ID NO: 1481 - DNA, 20 bp, synthetic construct
  source 1..20: mol_type = other DNA
tagtacttttaatggagttt

SEQ ID NO: 1482 - DNA, 20 bp, synthetic construct
  source 1..20: mol_type = other DNA
tttgacagtatgtcatgttt

SEQ ID NO: 1483 - DNA, 20 bp, synthetic construct
  source 1..20: mol_type = other DNA
tatgaggactttgacagtat

SEQ ID NO: 1484 - DNA, 20 bp, synthetic construct
  source 1..20: mol_type = other DNA
tttcctagatatgaggactt

SEQ ID NO: 1485 - DNA, 20 bp, synthetic construct
  source 1..20: mol_type = other DNA
ttctgtgtctttcctagata

SEQ ID NO: 1486 - DNA, 20 bp, synthetic construct
  source 1..20: mol_type = other DNA
ttctgtgacaaagagagttt

SEQ ID NO: 1487 - DNA, 20 bp, synthetic construct
  source 1..20: mol_type = other DNA
acagagagtttctgtgacaa

SEQ ID NO: 1488 - DNA, 20 bp, synthetic construct
  source 1..20: mol_type = other DNA
aggaaagacacagagagttt

SEQ ID NO: 1489 - DNA, 20 bp, synthetic construct
  source 1..20: mol_type = other DNA
gagttgaaaaacaactctat

SEQ ID NO: 1490 - DNA, 20 bp, synthetic construct
  source 1..20: mol_type = other DNA
tcaaacatagagttgaaaaa

SEQ ID NO: 1491 - DNA, 20 bp, synthetic construct
  source 1..20: mol_type = other DNA
tatccacattcaaacataga

SEQ ID NO: 1492 - DNA, 20 bp, synthetic construct
  source 1..20: mol_type = other DNA
tacactaattatacaaaatt

SEQ ID NO: 1493 - DNA, 20 bp, synthetic construct
  source 1..20: mol_type = other DNA
cactgtatttacactaatta

SEQ ID NO: 1494 - DNA, 20 bp, synthetic construct
  source 1..20: mol_type = other DNA
aggactgaacactgtattta

SEQ ID NO: 1495 - DNA, 20 bp, synthetic construct
  source 1..20: mol_type = other DNA
atcacttgaaggactgaaca

SEQ ID NO: 1496 - DNA, 20 bp, synthetic construct
  source 1..20: mol_type = other DNA
acaagtagctagtggtatga

SEQ ID NO: 1497 - DNA, 20 bp, synthetic construct
  source 1..20: mol_type = other DNA
gattagaaaacaagtagcta

SEQ ID NO: 1498 - DNA, 20 bp, synthetic construct
  source 1..20: mol_type = other DNA
tagaatgaagcagattagaa

SEQ ID NO: 1499 - DNA, 20 bp, synthetic construct
  source 1..20: mol_type = other DNA
ttagggaaaagatgaatata

SEQ ID NO: 1500 - DNA, 20 bp, synthetic construct
  source 1..20: mol_type = other DNA
atcacaaatttagggaaaag

SEQ ID NO: 1501 - DNA, 20 bp, synthetic construct
  source 1..20: mol_type = other DNA
atctgcagcatcacaaattt

SEQ ID NO: 1502 - DNA, 20 bp, synthetic construct
  source 1..20: mol_type = other DNA
aaaggtttctatctgaatga

SEQ ID NO: 1503 - DNA, 20 bp, synthetic construct
  source 1..20: mol_type = other DNA
ggaattctataattctgaaa

SEQ ID NO: 1504 - DNA, 20 bp, synthetic construct
  source 1..20: mol_type = other DNA
atggtcttggtaggagctgt

SEQ ID NO: 1505 - DNA, 20 bp, synthetic construct
  source 1..20: mol_type = other DNA
tttatcctcatggtcttggt

SEQ ID NO: 1506 - DNA, 20 bp, synthetic construct
  source 1..20: mol_type = other DNA
tgttagatatttatcctcat

SEQ ID NO: 1507 - DNA, 20 bp, synthetic construct
  source 1..20: mol_type = other DNA
gctcctttctccttcagcaa

SEQ ID NO: 1508 - DNA, 20 bp, synthetic construct
  source 1..20: mol_type = other DNA
ataactaaagctcctttctc

SEQ ID NO: 1509 - DNA, 20 bp, synthetic construct
  source 1..20: mol_type = other DNA
ttatccatcataactaaagc

SEQ ID NO: 1510 - DNA, 20 bp, synthetic construct
  source 1..20: mol_type = other DNA
cagatatttttatccatcat

SEQ ID NO: 1511 - DNA, 20 bp, synthetic construct
  source 1..20: mol_type = other DNA
tttggaagcctagggtggca

SEQ ID NO: 1512 - DNA, 20 bp, synthetic construct
  source 1..20: mol_type = other DNA
taagtataatttggaagcct

SEQ ID NO: 1513 - DNA, 20 bp, synthetic construct
  source 1..20: mol_type = other DNA
taaacaatttaagtataatt

SEQ ID NO: 1514 - DNA, 20 bp, synthetic construct
  source 1..20: mol_type = other DNA
tgatactcctattgtggtaa

SEQ ID NO: 1515 - DNA, 20 bp, synthetic construct
  source 1..20: mol_type = other DNA
atttggccctgatactccta

SEQ ID NO: 1516 - DNA, 20 bp, synthetic construct
  source 1..20: mol_type = other DNA
tacataggtatttggccctg

SEQ ID NO: 1517 - DNA, 20 bp, synthetic construct
  source 1..20: mol_type = other DNA
ctaaagcagaaatgacctca

SEQ ID NO: 1518 - DNA, 20 bp, synthetic construct
  source 1..20: mol_type = other DNA
gtacttttcctaaagcagaa

SEQ ID NO: 1519 - DNA, 20 bp, synthetic construct
  source 1..20: mol_type = other DNA
ttaccgaaagtacttttcct

SEQ ID NO: 1520 - DNA, 20 bp, synthetic construct
  source 1..20: mol_type = other DNA
tctgaaataatgaatactgg

SEQ ID NO: 1521 - DNA, 20 bp, synthetic construct
  source 1..20: mol_type = other DNA
agggaattatctgaaataat

SEQ ID NO: 1522 - DNA, 20 bp, synthetic construct
  source 1..20: mol_type = other DNA
attaaatgtactagttgtcc

SEQ ID NO: 1523 - DNA, 20 bp, synthetic construct
  source 1..20: mol_type = other DNA
tctgagaatattaaatgtac

SEQ ID NO: 1524 - DNA, 20 bp, synthetic construct
  source 1..20: mol_type = other DNA
gccataagttctgagaatat

SEQ ID NO: 1525 - DNA, 20 bp, synthetic construct
  source 1..20: mol_type = other DNA
tagtaaaatgccataagttc

SEQ ID NO: 1526 - DNA, 20 bp, synthetic construct
  source 1..20: mol_type = other DNA
cacatagtaaaatgccataa

SEQ ID NO: 1527 - DNA, 20 bp, synthetic construct
  source 1..20: mol_type = other DNA
tcacatagtaaaatgccata

SEQ ID NO: 1528 - DNA, 20 bp, synthetic construct
  source 1..20: mol_type = other DNA
ttcacatagtaaaatgccat

SEQ ID NO: 1529 - DNA, 20 bp, synthetic construct
  source 1..20: mol_type = other DNA
tttcacatagtaaaatgcca

SEQ ID NO: 1530 - DNA, 20 bp, synthetic construct
  source 1..20: mol_type = other DNA
ttttcacatagtaaaatgcc

SEQ ID NO: 1531 - DNA, 20 bp, synthetic construct
  source 1..20: mol_type = other DNA
agttttcacatagtaaaatg

SEQ ID NO: 1532 - DNA, 20 bp, synthetic construct
  source 1..20: mol_type = other DNA
aagttttcacatagtaaaat

SEQ ID NO: 1533 - DNA, 20 bp, synthetic construct
  source 1..20: mol_type = other DNA
aaagttttcacatagtaaaa

SEQ ID NO: 1534 - DNA, 20 bp, synthetic construct
  source 1..20: mol_type = other DNA
taaagttttcacatagtaaa

SEQ ID NO: 1535 - DNA, 20 bp, synthetic construct
  source 1..20: mol_type = other DNA
ttaaagttttcacatagtaa

SEQ ID NO: 1536 - DNA, 20 bp, synthetic construct
  source 1..20: mol_type = other DNA
taaatttaaagttttcacat

SEQ ID NO: 1537 - DNA, 20 bp, synthetic construct
  source 1..20: mol_type = other DNA
ttacccttaatataaataaa

SEQ ID NO: 1538 - DNA, 20 bp, synthetic construct
  source 1..20: mol_type = other DNA
agaatttgattacccttaat

SEQ ID NO: 1539 - DNA, 20 bp, synthetic construct
  source 1..20: mol_type = other DNA
gaaaatctttcatctttaag

SEQ ID NO: 1540 - DNA, 20 bp, synthetic construct
  source 1..20: mol_type = other DNA
cctttaaaatacagaaaatc

SEQ ID NO: 1541 - DNA, 20 bp, synthetic construct
  source 1..20: mol_type = other DNA
gcatagcttcctttaaaata

SEQ ID NO: 1542 - DNA, 20 bp, synthetic construct
  source 1..20: mol_type = other DNA
gttaattacataacaagtta

SEQ ID NO: 1543 - DNA, 20 bp, synthetic construct
  source 1..20: mol_type = other DNA
tattatatatgatttttttg

SEQ ID NO: 1544 - DNA, 20 bp, synthetic construct
  source 1..20: mol_type = other DNA
gagataacactggaacaaag

SEQ ID NO: 1545 - DNA, 20 bp, synthetic construct
  source 1..20: mol_type = other DNA
acaatgaaagagataacact

SEQ ID NO: 1546 - DNA, 20 bp, synthetic construct
  source 1..20: mol_type = other DNA
caaatacaaagtaacaatga

SEQ ID NO: 1547 - DNA, 20 bp, synthetic construct
  source 1..20: mol_type = other DNA
gtattcatttttttaatttg

SEQ ID NO: 1548 - DNA, 20 bp, synthetic construct
  source 1..20: mol_type = other DNA
tacctgctgcacactcgcga

SEQ ID NO: 1549 - DNA, 20 bp, synthetic construct
  source 1..20: mol_type = other DNA
atccaagatacatagcaaat

SEQ ID NO: 1550 - DNA, 20 bp, synthetic construct
  source 1..20: mol_type = other DNA
taatagtcagatggaaaata

SEQ ID NO: 1551 - DNA, 20 bp, synthetic construct
  source 1..20: mol_type = other DNA
tatcaagcaggagtgactct

SEQ ID NO: 1552 - DNA, 20 bp, synthetic construct
  source 1..20: mol_type = other DNA
ctctctaggcagaaatacta

SEQ ID NO: 1553 - DNA, 20 bp, synthetic construct
  source 1..20: mol_type = other DNA
atactttgcctctggtactc

SEQ ID NO: 1554 - DNA, 20 bp, synthetic construct
  source 1..20: mol_type = other DNA
caactatgatatatccaaaa

SEQ ID NO: 1555 - DNA, 20 bp, synthetic construct
  source 1..20: mol_type = other DNA
aaaagataggcaggaaaaga

SEQ ID NO: 1556 - DNA, 20 bp, synthetic construct
  source 1..20: mol_type = other DNA
tgccaaactcatctctgtac

SEQ ID NO: 1557 - DNA, 20 bp, synthetic construct
  source 1..20: mol_type = other DNA
gtaaacaacggctattttag

SEQ ID NO: 1558 - DNA, 20 bp, synthetic construct
  source 1..20: mol_type = other DNA
cccagaaacaaaagcaagcc

SEQ ID NO: 1559 - DNA, 20 bp, synthetic construct
  source 1..20: mol_type = other DNA
gtactgaaaacaagaagagc

SEQ ID NO: 1560 - DNA, 20 bp, synthetic construct
  source 1..20: mol_type = other DNA
ggacatttaaagttacaatt

SEQ ID NO: 1561 - DNA, 20 bp, synthetic construct
  source 1..20: mol_type = other DNA
tcttcttcacaactgcatgg

SEQ ID NO: 1562 - DNA, 20 bp, synthetic construct
  source 1..20: mol_type = other DNA
tttacattattggaagaaga

SEQ ID NO: 1563 - DNA, 20 bp, synthetic construct
  source 1..20: mol_type = other DNA
ctttacattattggaagaag

SEQ ID NO: 1564 - DNA, 20 bp, synthetic construct
  source 1..20: mol_type = other DNA
gctttacattattggaagaa

SEQ ID NO: 1565 - DNA, 20 bp, synthetic construct
  source 1..20: mol_type = other DNA
ggctttacattattggaaga

SEQ ID NO: 1566 - DNA, 20 bp, synthetic construct
  source 1..20: mol_type = other DNA
tggctttacattattggaag

SEQ ID NO: 1567 - DNA, 20 bp, synthetic construct
  source 1..20: mol_type = other DNA
tttggctttacattattgga

SEQ ID NO: 1568 - DNA, 20 bp, synthetic construct
  source 1..20: mol_type = other DNA
gtttggctttacattattgg

SEQ ID NO: 1569 - DNA, 20 bp, synthetic construct
  source 1..20: mol_type = other DNA
tgtttggctttacattattg

SEQ ID NO: 1570 - DNA, 20 bp, synthetic construct
  source 1..20: mol_type = other DNA
ttgtttggctttacattatt

SEQ ID NO: 1571 - DNA, 20 bp, synthetic construct
  source 1..20: mol_type = other DNA
attgtttggctttacattat

SEQ ID NO: 1572 - DNA, 20 bp, synthetic construct
  source 1..20: mol_type = other DNA
gaataattcacaatgtacac

SEQ ID NO: 1573 - DNA, 20 bp, synthetic construct
  source 1..20: mol_type = other DNA
catgtgtgtttgtttctttc

SEQ ID NO: 1574 - DNA, 20 bp, synthetic construct
  source 1..20: mol_type = other DNA
attcaaaccttcccaatcac

SEQ ID NO: 1575 - DNA, 20 bp, synthetic construct
  source 1..20: mol_type = other DNA
tccatcgccaaatggagaat

SEQ ID NO: 1576 - DNA, 20 bp, synthetic construct
  source 1..20: mol_type = other DNA
aatactggaataggagtagt

SEQ ID NO: 1577 - DNA, 20 bp, synthetic construct
  source 1..20: mol_type = other DNA
tctcatgatccttagtatga

SEQ ID NO: 1578 - DNA, 20 bp, synthetic construct
  source 1..20: mol_type = other DNA
acctggcctactcctgttcc

SEQ ID NO: 1579 - DNA, 20 bp, synthetic construct
  source 1..20: mol_type = other DNA
atgcatattagtctttttcc

SEQ ID NO: 1580 - DNA, 20 bp, synthetic construct
  source 1..20: mol_type = other DNA
ctgccactgtaatcacctct

SEQ ID NO: 1581 - DNA, 20 bp, synthetic construct
  source 1..20: mol_type = other DNA
tacatattgtctaataatcc

SEQ ID NO: 1582 - DNA, 20 bp, synthetic construct
  source 1..20: mol_type = other DNA
tttgttggcagtgatgtctc

SEQ ID NO: 1583 - DNA, 20 bp, synthetic construct
  source 1..20: mol_type = other DNA
ttaaaaacttttgatttctt

SEQ ID NO: 1584 - DNA, 20 bp, synthetic construct
  source 1..20: mol_type = other DNA
aagggcaaccaatgtacaag

SEQ ID NO: 1585 - DNA, 20 bp, synthetic construct
  source 1..20: mol_type = other DNA
tatgacctgtttcctccatt

SEQ ID NO: 1586 - DNA, 20 bp, synthetic construct
  source 1..20: mol_type = other DNA
ctatgacctgtttcctccat

SEQ ID NO: 1587 - DNA, 20 bp, synthetic construct
  source 1..20: mol_type = other DNA
gctatgacctgtttcctcca

SEQ ID NO: 1588 - DNA, 20 bp, synthetic construct
  source 1..20: mol_type = other DNA
agctatgacctgtttcctcc

SEQ ID NO: 1589 - DNA, 20 bp, synthetic construct
  source 1..20: mol_type = other DNA
cagctatgacctgtttcctc

SEQ ID NO: 1590 - DNA, 20 bp, synthetic construct
  source 1..20: mol_type = other DNA
atcagctatgacctgtttcc

SEQ ID NO: 1591 - DNA, 20 bp, synthetic construct
  source 1..20: mol_type = other DNA
aatcagctatgacctgtttc

SEQ ID NO: 1592 - DNA, 20 bp, synthetic construct
  source 1..20: mol_type = other DNA
aaaatcagctatgacctgtt

SEQ ID NO: 1593 - DNA, 20 bp, synthetic construct
  source 1..20: mol_type = other DNA
taaaatcagctatgacctgt

SEQ ID NO: 1594 - DNA, 20 bp, synthetic construct
  source 1..20: mol_type = other DNA
atgtggtgaatattatagaa

SEQ ID NO: 1595 - DNA, 20 bp, synthetic construct
  source 1..20: mol_type = other DNA
ctttattgaaaattgccaca

SEQ ID NO: 1596 - DNA, 20 bp, synthetic construct
  source 1..20: mol_type = other DNA
catttaagttggatagtgag

SEQ ID NO: 1597 - DNA, 20 bp, synthetic construct
  source 1..20: mol_type = other DNA
ggaataaaatatacaatata

SEQ ID NO: 1598 - DNA, 20 bp, synthetic construct
  source 1..20: mol_type = other DNA
agttcttcttaaaatgatcc

SEQ ID NO: 1599 - DNA, 20 bp, synthetic construct
  source 1..20: mol_type = other DNA
aagcccacattgaaaaaaca

SEQ ID NO: 1600 - DNA, 20 bp, synthetic construct
  source 1..20: mol_type = other DNA
tgaaaataaacagagaagat

SEQ ID NO: 1601 - DNA, 20 bp, synthetic construct
  source 1..20: mol_type = other DNA
atgtgaaaataaacagagaa

SEQ ID NO: 1602 - DNA, 20 bp, synthetic construct
  source 1..20: mol_type = other DNA
agcctagaagcagttggttt

SEQ ID NO: 1603 - DNA, 20 bp, synthetic construct
  source 1..20: mol_type = other DNA
aataataacaatatcccatc

SEQ ID NO: 1604 - DNA, 20 bp, synthetic construct
  source 1..20: mol_type = other DNA
aagattgatgaaccacagga

SEQ ID NO: 1605 - DNA, 20 bp, synthetic construct
  source 1..20: mol_type = other DNA
atttcatcccttactgctta

SEQ ID NO: 1606 - DNA, 20 bp, synthetic construct
  source 1..20: mol_type = other DNA
agagataatcaagagaaaaa

SEQ ID NO: 1607 - DNA, 20 bp, synthetic construct
  source 1..20: mol_type = other DNA
agtatggagctcctttacca

SEQ ID NO: 1608 - DNA, 20 bp, synthetic construct
  source 1..20: mol_type = other DNA
tacattgagatgtgtatatt

SEQ ID NO: 1609 - DNA, 20 bp, synthetic construct
  source 1..20: mol_type = other DNA
tgctttaggagaagccttgg

SEQ ID NO: 1610 - DNA, 20 bp, synthetic construct
  source 1..20: mol_type = other DNA
gtgctttaggagaagccttg

SEQ ID NO: 1611 - DNA, 20 bp, synthetic construct
  source 1..20: mol_type = other DNA
tgtgctttaggagaagcctt

SEQ ID NO: 1612 - DNA, 20 bp, synthetic construct
  source 1..20: mol_type = other DNA
gtgtgctttaggagaagcct

SEQ ID NO: 1613 - DNA, 20 bp, synthetic construct
  source 1..20: mol_type = other DNA
ggtgtgctttaggagaagcc

SEQ ID NO: 1614 - DNA, 20 bp, synthetic construct
  source 1..20: mol_type = other DNA
gaggtgtgctttaggagaag

SEQ ID NO: 1615 - DNA, 20 bp, synthetic construct
  source 1..20: mol_type = other DNA
tgaggtgtgctttaggagaa

SEQ ID NO: 1616 - DNA, 20 bp, synthetic construct
  source 1..20: mol_type = other DNA
atgaggtgtgctttaggaga

SEQ ID NO: 1617 - DNA, 20 bp, synthetic construct
  source 1..20: mol_type = other DNA
aatgaggtgtgctttaggag

SEQ ID NO: 1618 - DNA, 20 bp, synthetic construct
  source 1..20: mol_type = other DNA
gaatgaggtgtgctttagga

SEQ ID NO: 1619 - DNA, 20 bp, synthetic construct
  source 1..20: mol_type = other DNA
attttaaaacgatcagccag

SEQ ID NO: 1620 - DNA, 20 bp, synthetic construct
  source 1..20: mol_type = other DNA
agttgggaactcatcatagg

SEQ ID NO: 1621 - DNA, 20 bp, synthetic construct
  source 1..20: mol_type = other DNA
aggctcacggatatgaaaca

SEQ ID NO: 1622 - DNA, 20 bp, synthetic construct
  source 1..20: mol_type = other DNA
aagagaggaaaaactgaaaa

SEQ ID NO: 1623 - DNA, 20 bp, synthetic construct
  source 1..20: mol_type = other DNA
gtttacacatagaagtccgg

SEQ ID NO: 1624 - DNA, 20 bp, synthetic construct
  source 1..20: mol_type = other DNA
taaagggatacaagccattt

SEQ ID NO: 1625 - DNA, 20 bp, synthetic construct
  source 1..20: mol_type = other DNA
tccttgagagcagcccctgt

SEQ ID NO: 1626 - DNA, 20 bp, synthetic construct
  source 1..20: mol_type = other DNA
attcgagaacagcgattccc

SEQ ID NO: 1627 - DNA, 20 bp, synthetic construct
  source 1..20: mol_type = other DNA
actgaacaaagacatcaggg

SEQ ID NO: 1628 - DNA, 20 bp, synthetic construct
  source 1..20: mol_type = other DNA
atgaacgagctactcaagtt

SEQ ID NO: 1629 - DNA, 20 bp, synthetic construct
  source 1..20: mol_type = other DNA
aagaaagttgatgaacgagc

SEQ ID NO: 1630 - DNA, 20 bp, synthetic construct
  source 1..20: mol_type = other DNA
cctgccaatgtagccatttt

SEQ ID NO: 1631 - DNA, 20 bp, synthetic construct
  source 1..20: mol_type = other DNA
gaataggaaaaatgtcacac

SEQ ID NO: 1632 - DNA, 20 bp, synthetic construct
  source 1..20: mol_type = other DNA
gtcttactcaatagtcacct

SEQ ID NO: 1633 - DNA, 20 bp, synthetic construct
  source 1..20: mol_type = other DNA
tcttgatctcatccactcca

SEQ ID NO: 1634 - DNA, 20 bp, synthetic construct
  source 1..20: mol_type = other DNA
caagtgtcttatgtttttct

SEQ ID NO: 1635 - DNA, 20 bp, synthetic construct
  source 1..20: mol_type = other DNA
gattttatcttttataactt

SEQ ID NO: 1636 - DNA, 20 bp, synthetic construct
  source 1..20: mol_type = other DNA
tctgtttacttatcagtctc

SEQ ID NO: 1637 - DNA, 20 bp, synthetic construct
  source 1..20: mol_type = other DNA
gcagtaggtactatgaactt

SEQ ID NO: 1638 - DNA, 20 bp, synthetic construct
  source 1..20: mol_type = other DNA
cttgaactcaggtcatggca

SEQ ID NO: 1639 - DNA, 20 bp, synthetic construct
  source 1..20: mol_type = other DNA
ctcacccccgaccatgtgca

SEQ ID NO: 1640 - DNA, 20 bp, synthetic construct
  source 1..20: mol_type = other DNA
cacaatgctattgtctttag

SEQ ID NO: 1641 - DNA, 20 bp, synthetic construct
  source 1..20: mol_type = other DNA
cataatgtacatctttgcca

SEQ ID NO: 1642 - DNA, 20 bp, synthetic construct
  source 1..20: mol_type = other DNA
aatgtctatataacaagtta

SEQ ID NO: 1643 - DNA, 20 bp, synthetic construct
  source 1..20: mol_type = other DNA
tatatcccttcttaaagaat

SEQ ID NO: 1644 - DNA, 20 bp, synthetic construct
  source 1..20: mol_type = other DNA
cgtgtggactgtaaattttt

SEQ ID NO: 1645 - DNA, 20 bp, synthetic construct
  source 1..20: mol_type = other DNA
catcatgctacatgtaatgg

SEQ ID NO: 1646 - DNA, 20 bp, synthetic construct
  source 1..20: mol_type = other DNA
tgctgggaatactatggtaa

SEQ ID NO: 1647 - DNA, 20 bp, synthetic construct
  source 1..20: mol_type = other DNA
attccaattacatgccaagg

SEQ ID NO: 1648 - DNA, 20 bp, synthetic construct
  source 1..20: mol_type = other DNA
atctgcattaatgcaaactg

SEQ ID NO: 1649 - DNA, 20 bp, synthetic construct
  source 1..20: mol_type = other DNA
attcttctggcatgcctaaa

SEQ ID NO: 1650 - DNA, 20 bp, synthetic construct
  source 1..20: mol_type = other DNA
tcatcttatgtctctaacca

SEQ ID NO: 1651 - DNA, 20 bp, synthetic construct
  source 1..20: mol_type = other DNA
tactttgctgagtaccatcc

SEQ ID NO: 1652 - DNA, 20 bp, synthetic construct
  source 1..20: mol_type = other DNA
aggaagtaaccatgtcctca

SEQ ID NO: 1653 - DNA, 20 bp, synthetic construct
  source 1..20: mol_type = other DNA
aaggaagtaaccatgtcctc

SEQ ID NO: 1654 - DNA, 20 bp, synthetic construct
  source 1..20: mol_type = other DNA
aaaggaagtaaccatgtcct

SEQ ID NO: 1655 - DNA, 20 bp, synthetic construct
  source 1..20: mol_type = other DNA
aaaaggaagtaaccatgtcc

SEQ ID NO: 1656 - DNA, 20 bp, synthetic construct
  source 1..20: mol_type = other DNA
taaaaggaagtaaccatgtc

SEQ ID NO: 1657 - DNA, 20 bp, synthetic construct
  source 1..20: mol_type = other DNA
attaaaaggaagtaaccatg

SEQ ID NO: 1658 - DNA, 20 bp, synthetic construct
  source 1..20: mol_type = other DNA
tattaaaaggaagtaaccat

SEQ ID NO: 1659 - DNA, 20 bp, synthetic construct
  source 1..20: mol_type = other DNA
gtattaaaaggaagtaacca

SEQ ID NO: 1660 - DNA, 20 bp, synthetic construct
  source 1..20: mol_type = other DNA
ggtattaaaaggaagtaacc

SEQ ID NO: 1661 - DNA, 20 bp, synthetic construct
  source 1..20: mol_type = other DNA
aggtattaaaaggaagtaac

SEQ ID NO: 1662 - DNA, 20 bp, synthetic construct
  source 1..20: mol_type = other DNA
tatgtatccaaacatggatt

SEQ ID NO: 1663 - DNA, 20 bp, synthetic construct
  source 1..20: mol_type = other DNA
ggtgacaaagtcttcatctg

SEQ ID NO: 1664 - DNA, 20 bp, synthetic construct
  source 1..20: mol_type = other DNA
tttatttgagtctatttcct

SEQ ID NO: 1665 - DNA, 20 bp, synthetic construct
  source 1..20: mol_type = other DNA
gggtgcatagtctgtaggta

SEQ ID NO: 1666 - DNA, 20 bp, synthetic construct
  source 1..20: mol_type = other DNA
ggatttcaagagaaaaaatc

SEQ ID NO: 1667 - DNA, 20 bp, synthetic construct
  source 1..20: mol_type = other DNA
atatctttaccatgtatatg

SEQ ID NO: 1668 - DNA, 20 bp, synthetic construct
  source 1..20: mol_type = other DNA
tccaaactcagaatgcacca

SEQ ID NO: 1669 - DNA, 20 bp, synthetic construct
  source 1..20: mol_type = other DNA
gtctatgagtaatggcatgg

SEQ ID NO: 1670 - DNA, 20 bp, synthetic construct
  source 1..20: mol_type = other DNA
ggattaaaatcaatttatca

SEQ ID NO: 1671 - DNA, 20 bp, synthetic construct
  source 1..20: mol_type = other DNA
aatttcttttggcttgatac

SEQ ID NO: 1672 - DNA, 20 bp, synthetic construct
  source 1..20: mol_type = other DNA
ttcaaattatgcgaatctga

SEQ ID NO: 1673 - DNA, 20 bp, synthetic construct
  source 1..20: mol_type = other DNA
ttggacatcatttcatttat

SEQ ID NO: 1674 - DNA, 20 bp, synthetic construct
  source 1..20: mol_type = other DNA
accttaaaagcccaggatct

SEQ ID NO: 1675 - DNA, 20 bp, synthetic construct
  source 1..20: mol_type = other DNA
actttaaagatgcagaaata

SEQ ID NO: 1676 - DNA, 20 bp, synthetic construct
  source 1..20: mol_type = other DNA
aactttaaagatgcagaaat

SEQ ID NO: 1677 - DNA, 20 bp, synthetic construct
  source 1..20: mol_type = other DNA
aaactttaaagatgcagaaa

SEQ ID NO: 1678 - DNA, 20 bp, synthetic construct
  source 1..20: mol_type = other DNA
caaactttaaagatgcagaa

SEQ ID NO: 1679 - DNA, 20 bp, synthetic construct
  source 1..20: mol_type = other DNA
ccaaactttaaagatgcaga

SEQ ID NO: 1680 - DNA, 20 bp, synthetic construct
  source 1..20: mol_type = other DNA
tgccaaactttaaagatgca

SEQ ID NO: 1681 - DNA, 20 bp, synthetic construct
  source 1..20: mol_type = other DNA
ttgccaaactttaaagatgc

SEQ ID NO: 1682 - DNA, 20 bp, synthetic construct
  source 1..20: mol_type = other DNA
tttgccaaactttaaagatg

SEQ ID NO: 1683 - DNA, 20 bp, synthetic construct
  source 1..20: mol_type = other DNA
gtttgccaaactttaaagat

SEQ ID NO: 1684 - DNA, 20 bp, synthetic construct
  source 1..20: mol_type = other DNA
ggtttgccaaactttaaaga

SEQ ID NO: 1685 - DNA, 20 bp, synthetic construct
  source 1..20: mol_type = other DNA
ccaaatatgtttcaccccag

SEQ ID NO: 1686 - DNA, 20 bp, synthetic construct
  source 1..20: mol_type = other DNA
agcatttttacaattaagga

SEQ ID NO: 1687 - DNA, 20 bp, synthetic construct
  source 1..20: mol_type = other DNA
catactttagtctgtatttc

SEQ ID NO: 1688 - DNA, 20 bp, synthetic construct
  source 1..20: mol_type = other DNA
ttattatatatcatgtttta

SEQ ID NO: 1689 - DNA, 20 bp, synthetic construct
  source 1..20: mol_type = other DNA
gttattatatatcatgtttt

SEQ ID NO: 1690 - DNA, 20 bp, synthetic construct
  source 1..20: mol_type = other DNA
agttattatatatcatgttt

SEQ ID NO: 1691 - DNA, 20 bp, synthetic construct
  source 1..20: mol_type = other DNA
cagttattatatatcatgtt

SEQ ID NO: 1692 - DNA, 20 bp, synthetic construct
  source 1..20: mol_type = other DNA
acagttattatatatcatgt

SEQ ID NO: 1693 - DNA, 20 bp, synthetic construct
  source 1..20: mol_type = other DNA
agacagttattatatatcat

SEQ ID NO: 1694 - DNA, 20 bp, synthetic construct
  source 1..20: mol_type = other DNA
aagacagttattatatatca

SEQ ID NO: 1695 - DNA, 20 bp, synthetic construct
  source 1..20: mol_type = other DNA
aaagacagttattatatatc

SEQ ID NO: 1696 - DNA, 20 bp, synthetic construct
  source 1..20: mol_type = other DNA
caaagacagttattatatat

SEQ ID NO: 1697 - DNA, 20 bp, synthetic construct
  source 1..20: mol_type = other DNA
acaaagacagttattatata

SEQ ID NO: 1698 - DNA, 20 bp, synthetic construct
  source 1..20: mol_type = other DNA
ttcctgagtcagctgggcac

SEQ ID NO: 1699 - DNA, 20 bp, synthetic construct
  source 1..20: mol_type = other DNA
gttgagtgtagttgagaagc

SEQ ID NO: 1700 - DNA, 20 bp, synthetic construct
  source 1..20: mol_type = other DNA
aaagatgcttgtctaaagcc

SEQ ID NO: 1701 - DNA, 20 bp, synthetic construct
  source 1..20: mol_type = other DNA
aataaatactccctctctct

SEQ ID NO: 1702 - DNA, 20 bp, synthetic construct
  source 1..20: mol_type = other DNA
actaaaaagagtggaaatga

SEQ ID NO: 1703 - DNA, 20 bp, synthetic construct
  source 1..20: mol_type = other DNA
ggcaaacatagtactttatt

SEQ ID NO: 1704 - DNA, 20 bp, synthetic construct
  source 1..20: mol_type = other DNA
tgttgcttgcttaaaagaaa

SEQ ID NO: 1705 - DNA, 20 bp, synthetic construct
  source 1..20: mol_type = other DNA
tactgctcacagatatttat

SEQ ID NO: 1706 - DNA, 20 bp, synthetic construct
  source 1..20: mol_type = other DNA
ctcttgtcaatgccctacac

SEQ ID NO: 1707 - DNA, 20 bp, synthetic construct
  source 1..20: mol_type = other DNA
gcaaaaaggtgttcattctt

SEQ ID NO: 1708 - DNA, 20 bp, synthetic construct
  source 1..20: mol_type = other DNA
acttttcacccagcaaaaag

SEQ ID NO: 1709 - DNA, 20 bp, synthetic construct
  source 1..20: mol_type = other DNA
atgctatttctattacccca

SEQ ID NO: 1710 - DNA, 20 bp, synthetic construct
  source 1..20: mol_type = other DNA
accttcctctaaatgttatg

SEQ ID NO: 1711 - DNA, 20 bp, synthetic construct
  source 1..20: mol_type = other DNA
ctgtcctgcctttatttgtg

SEQ ID NO: 1712 - DNA, 20 bp, synthetic construct
  source 1..20: mol_type = other DNA
tgttacttacttgtttgttt

SEQ ID NO: 1713 - DNA, 20 bp, synthetic construct
  source 1..20: mol_type = other DNA
ttgacttcatggtactaaca

SEQ ID NO: 1714 - DNA, 20 bp, synthetic construct
  source 1..20: mol_type = other DNA
caaagcattccacaacatgt

SEQ ID NO: 1715 - DNA, 20 bp, synthetic construct
  source 1..20: mol_type = other DNA
tgcattttcatcaacattag

SEQ ID NO: 1716 - DNA, 20 bp, synthetic construct
  source 1..20: mol_type = other DNA
tttttggcataagactagtt

SEQ ID NO: 1717 - DNA, 20 bp, synthetic construct
  source 1..20: mol_type = other DNA
tctatgtttttttaactggg

SEQ ID NO: 1718 - DNA, 20 bp, synthetic construct
  source 1..20: mol_type = other DNA
caacagtaggaatagcaata

SEQ ID NO: 1719 - DNA, 20 bp, synthetic construct
  source 1..20: mol_type = other DNA
gtttgctgagtgattcatta

SEQ ID NO: 1720 - DNA, 20 bp, synthetic construct
  source 1..20: mol_type = other DNA
aatggtttgacttgagacac

SEQ ID NO: 1721 - DNA, 20 bp, synthetic construct
  source 1..20: mol_type = other DNA
aattttcaaagcgcatgaaa

SEQ ID NO: 1722 - DNA, 20 bp, synthetic construct
  source 1..20: mol_type = other DNA
ttaattttcaaagcgcatga

SEQ ID NO: 1723 - DNA, 20 bp, synthetic construct
  source 1..20: mol_type = other DNA
gttaattttcaaagcgcatg

SEQ ID NO: 1724 - DNA, 20 bp, synthetic construct
  source 1..20: mol_type = other DNA
tgttaattttcaaagcgcat

SEQ ID NO: 1725 - DNA, 20 bp, synthetic construct
  source 1..20: mol_type = other DNA
tatgttaattttcaaagcgc

SEQ ID NO: 1726 - DNA, 20 bp, synthetic construct
  source 1..20: mol_type = other DNA
atatgttaattttcaaagcg

SEQ ID NO: 1727 - DNA, 20 bp, synthetic construct
  source 1..20: mol_type = other DNA
aatatgttaattttcaaagc

SEQ ID NO: 1728 - DNA, 20 bp, synthetic construct
  source 1..20: mol_type = other DNA
gaatatgttaattttcaaag

SEQ ID NO: 1729 - DNA, 20 bp, synthetic construct
  source 1..20: mol_type = other DNA
tgaatatgttaattttcaaa

SEQ ID NO: 1730 - DNA, 20 bp, synthetic construct
  source 1..20: mol_type = other DNA
agaatgctcatgtactgctg

SEQ ID NO: 1731 - DNA, 20 bp, synthetic construct
  source 1..20: mol_type = other DNA
cagaatgctcatgtactgct

SEQ ID NO: 1732 - DNA, 20 bp, synthetic construct
  source 1..20: mol_type = other DNA
ctgtcacaacttctatctag

SEQ ID NO: 1733 - DNA, 20 bp, synthetic construct
  source 1..20: mol_type = other DNA
gtttcttaagtgggatacaa

SEQ ID NO: 1734 - DNA, 20 bp, synthetic construct
  source 1..20: mol_type = other DNA
acttaaaatgttttagacct

SEQ ID NO: 1735 - DNA, 20 bp, synthetic construct
  source 1..20: mol_type = other DNA
aatacctcagcagatgctga

SEQ ID NO: 1736 - DNA, 20 bp, synthetic construct
  source 1..20: mol_type = other DNA
cacattactaaaactgactt

SEQ ID NO: 1737 - DNA, 20 bp, synthetic construct
  source 1..20: mol_type = other DNA
aaaccagtgttctaagcttc

SEQ ID NO: 1738 - DNA, 20 bp, synthetic construct
  source 1..20: mol_type = other DNA
aaatgatactaactgcaaac

SEQ ID NO: 1739 - DNA, 20 bp, synthetic construct
  source 1..20: mol_type = other DNA
aagaaaatgatactaactgc

SEQ ID NO: 1740 - DNA, 20 bp, synthetic construct
  source 1..20: mol_type = other DNA
taatctgcatatgggtttct

SEQ ID NO: 1741 - DNA, 20 bp, synthetic construct
  source 1..20: mol_type = other DNA
agattattaaattatcataa

SEQ ID NO: 1742 - DNA, 20 bp, synthetic construct
  source 1..20: mol_type = other DNA
tatttgaatttcatgtttca

SEQ ID NO: 1743 - DNA, 20 bp, synthetic construct
  source 1..20: mol_type = other DNA
tttttatggagaccgctgga

SEQ ID NO: 1744 - DNA, 20 bp, synthetic construct
  source 1..20: mol_type = other DNA
gtccattccctttgtaaaat

SEQ ID NO: 1745 - DNA, 20 bp, synthetic construct
  source 1..20: mol_type = other DNA
tggaaatttcacagtccatt

SEQ ID NO: 1746 - DNA, 20 bp, synthetic construct
  source 1..20: mol_type = other DNA
tcattaaccaaactactttt

SEQ ID NO: 1747 - DNA, 20 bp, synthetic construct
  source 1..20: mol_type = other DNA
attatgaggataaaagaaaa

SEQ ID NO: 1748 - DNA, 20 bp, synthetic construct
  source 1..20: mol_type = other DNA
aattatgaggataaaagaaa

SEQ ID NO: 1749 - DNA, 20 bp, synthetic construct
  source 1..20: mol_type = other DNA
caattatgaggataaaagaa

SEQ ID NO: 1750 - DNA, 20 bp, synthetic construct
  source 1..20: mol_type = other DNA
ccaattatgaggataaaaga

SEQ ID NO: 1751 - DNA, 20 bp, synthetic construct
  source 1..20: mol_type = other DNA
cccaattatgaggataaaag

SEQ ID NO: 1752 - DNA, 20 bp, synthetic construct
  source 1..20: mol_type = other DNA
aacccaattatgaggataaa

SEQ ID NO: 1753 - DNA, 20 bp, synthetic construct
  source 1..20: mol_type = other DNA
gaacccaattatgaggataa

SEQ ID NO: 1754 - DNA, 20 bp, synthetic construct
  source 1..20: mol_type = other DNA
agaacccaattatgaggata

SEQ ID NO: 1755 - DNA, 20 bp, synthetic construct
  source 1..20: mol_type = other DNA
aagaacccaattatgaggat

SEQ ID NO: 1756 - DNA, 20 bp, synthetic construct
  source 1..20: mol_type = other DNA
taagaacccaattatgagga

SEQ ID NO: 1757 - DNA, 20 bp, synthetic construct
  source 1..20: mol_type = other DNA
agatctgtttccattgcctg

SEQ ID NO: 1758 - DNA, 20 bp, synthetic construct
  source 1..20: mol_type = other DNA
ctttaagttacacattattt

SEQ ID NO: 1759 - DNA, 20 bp, synthetic construct
  source 1..20: mol_type = other DNA
caaactatgttatactttaa

SEQ ID NO: 1760 - DNA, 20 bp, synthetic construct
  source 1..20: mol_type = other DNA
actcttcagagtctgaaaag

SEQ ID NO: 1761 - DNA, 20 bp, synthetic construct
  source 1..20: mol_type = other DNA
aactcttcagagtctgaaaa

SEQ ID NO: 1762 - DNA, 20 bp, synthetic construct
  source 1..20: mol_type = other DNA
aaactcttcagagtctgaaa

SEQ ID NO: 1763 - DNA, 20 bp, synthetic construct
  source 1..20: mol_type = other DNA
caaactcttcagagtctgaa

SEQ ID NO: 1764 - DNA, 20 bp, synthetic construct
  source 1..20: mol_type = other DNA
tcaaactcttcagagtctga

SEQ ID NO: 1765 - DNA, 20 bp, synthetic construct
  source 1..20: mol_type = other DNA
tgtcaaactcttcagagtct

SEQ ID NO: 1766 - DNA, 20 bp, synthetic construct
  source 1..20: mol_type = other DNA
gtgtcaaactcttcagagtc

SEQ ID NO: 1767 - DNA, 20 bp, synthetic construct
  source 1..20: mol_type = other DNA
atagttgggaacgaatagta

SEQ ID NO: 1768 - DNA, 20 bp, synthetic construct
  source 1..20: mol_type = other DNA
tatagttgggaacgaatagt

SEQ ID NO: 1769 - DNA, 20 bp, synthetic construct
  source 1..20: mol_type = other DNA
ttatagttgggaacgaatag

SEQ ID NO: 1770 - DNA, 20 bp, synthetic construct
  source 1..20: mol_type = other DNA
cttatagttgggaacgaata

SEQ ID NO: 1771 - DNA, 20 bp, synthetic construct
  source 1..20: mol_type = other DNA
tcttatagttgggaacgaat

SEQ ID NO: 1772 - DNA, 20 bp, synthetic construct
  source 1..20: mol_type = other DNA
tgtcttatagttgggaacga

SEQ ID NO: 1773 - DNA, 20 bp, synthetic construct
  source 1..20: mol_type = other DNA
atgtcttatagttgggaacg

SEQ ID NO: 1774 - DNA, 20 bp, synthetic construct
  source 1..20: mol_type = other DNA
aatgtcttatagttgggaac

SEQ ID NO: 1775 - DNA, 20 bp, synthetic construct
  source 1..20: mol_type = other DNA
gaatgtcttatagttgggaa

SEQ ID NO: 1776 - DNA, 20 bp, synthetic construct
  source 1..20: mol_type = other DNA
agaatgtcttatagttggga

SEQ ID NO: 1777 - DNA, 20 bp, synthetic construct
  source 1..20: mol_type = other DNA
taaggacagagaccgagttt

SEQ ID NO: 1778 - DNA, 20 bp, synthetic construct
  source 1..20: mol_type = other DNA
catttacatgggattatttt

SEQ ID NO: 1779 - DNA, 20 bp, synthetic construct
  source 1..20: mol_type = other DNA
atagctattatacctcacct

SEQ ID NO: 1780 - DNA, 20 bp, synthetic construct
  source 1..20: mol_type = other DNA
attgttaagaaggaaatgca

SEQ ID NO: 1781 - DNA, 20 bp, synthetic construct
  source 1..20: mol_type = other DNA
actctggtatattttatgat

SEQ ID NO: 1782 - DNA, 20 bp, synthetic construct
  source 1..20: mol_type = other DNA
agagattgggaaacattcag

SEQ ID NO: 1783 - DNA, 20 bp, synthetic construct
  source 1..20: mol_type = other DNA
tatagcaaaacaactatgaa

SEQ ID NO: 1784 - DNA, 20 bp, synthetic construct
  source 1..20: mol_type = other DNA
ccccaaaatttcactcaaac

SEQ ID NO: 1785 - DNA, 20 bp, synthetic construct
  source 1..20: mol_type = other DNA
tgtttgaaggaatagctgac

SEQ ID NO: 1786 - DNA, 20 bp, synthetic construct
  source 1..20: mol_type = other DNA
gtgtttgaaggaatagctga

SEQ ID NO: 1787 - DNA, 20 bp, synthetic construct
  source 1..20: mol_type = other DNA
tagtgtttgaaggaatagct

SEQ ID NO: 1788 - DNA, 20 bp, synthetic construct
  source 1..20: mol_type = other DNA
atagtgtttgaaggaatagc

SEQ ID NO: 1789 - DNA, 20 bp, synthetic construct
  source 1..20: mol_type = other DNA
ccatagtgtttgaaggaata

SEQ ID NO: 1790 - DNA, 20 bp, synthetic construct
  source 1..20: mol_type = other DNA
gccatagtgtttgaaggaat

SEQ ID NO: 1791 - DNA, 20 bp, synthetic construct
  source 1..20: mol_type = other DNA
aagccatagtgtttgaagga

SEQ ID NO: 1792 - DNA, 20 bp, synthetic construct
  source 1..20: mol_type = other DNA
aaagccatagtgtttgaagg

SEQ ID NO: 1793 - DNA, 20 bp, synthetic construct
  source 1..20: mol_type = other DNA
aaaaagccatagtgtttgaa

SEQ ID NO: 1794 - DNA, 20 bp, synthetic construct
  source 1..20: mol_type = other DNA
taaaaagccatagtgtttga

SEQ ID NO: 1795 - DNA, 20 bp, synthetic construct
  source 1..20: mol_type = other DNA
tctaaaaagccatagtgttt

SEQ ID NO: 1796 - DNA, 20 bp, synthetic construct
  source 1..20: mol_type = other DNA
ttctaaaaagccatagtgtt

SEQ ID NO: 1797 - DNA, 20 bp, synthetic construct
  source 1..20: mol_type = other DNA
atcatgcaagcagcatttta

SEQ ID NO: 1798 - DNA, 20 bp, synthetic construct
  source 1..20: mol_type = other DNA
catcatgcaagcagcatttt

SEQ ID NO: 1799 - DNA, 20 bp, synthetic construct
  source 1..20: mol_type = other DNA
gcatcatgcaagcagcattt

SEQ ID NO: 1800 - DNA, 20 bp, synthetic construct
  source 1..20: mol_type = other DNA
agcatcatgcaagcagcatt

SEQ ID NO: 1801 - DNA, 20 bp, synthetic construct
  source 1..20: mol_type = other DNA
cagcatcatgcaagcagcat

SEQ ID NO: 1802 - DNA, 20 bp, synthetic construct
  source 1..20: mol_type = other DNA
tgcagcatcatgcaagcagc

SEQ ID NO: 1803 - DNA, 20 bp, synthetic construct
  source 1..20: mol_type = other DNA
ttgcagcatcatgcaagcag

SEQ ID NO: 1804 - DNA, 20 bp, synthetic construct
  source 1..20: mol_type = other DNA
cattgcagcatcatgcaagc

SEQ ID NO: 1805 - DNA, 20 bp, synthetic construct
  source 1..20: mol_type = other DNA
tcattgcagcatcatgcaag

SEQ ID NO: 1806 - DNA, 20 bp, synthetic construct
  source 1..20: mol_type = other DNA
ggagataataacagtggcta

SEQ ID NO: 1807 - DNA, 20 bp, synthetic construct
  source 1..20: mol_type = other DNA
gtggaagtattaaggctact

SEQ ID NO: 1808 - DNA, 20 bp, synthetic construct
  source 1..20: mol_type = other DNA
agtggaagtattaaggctac

SEQ ID NO: 1809 - DNA, 20 bp, synthetic construct
  source 1..20: mol_type = other DNA
tagtggaagtattaaggcta

SEQ ID NO: 1810 - DNA, 20 bp, synthetic construct
  source 1..20: mol_type = other DNA
ttagtggaagtattaaggct

SEQ ID NO: 1811 - DNA, 20 bp, synthetic construct
  source 1..20: mol_type = other DNA
tttagtggaagtattaaggc

SEQ ID NO: 1812 - DNA, 20 bp, synthetic construct
  source 1..20: mol_type = other DNA
tgtttagtggaagtattaag

SEQ ID NO: 1813 - DNA, 20 bp, synthetic construct
  source 1..20: mol_type = other DNA
ttgtttagtggaagtattaa

SEQ ID NO: 1814 - DNA, 20 bp, synthetic construct
  source 1..20: mol_type = other DNA
attgtttagtggaagtatta

SEQ ID NO: 1815 - DNA, 20 bp, synthetic construct
  source 1..20: mol_type = other DNA
tattgtttagtggaagtatt

SEQ ID NO: 1816 - DNA, 20 bp, synthetic construct
  source 1..20: mol_type = other DNA
ttattgtttagtggaagtat

SEQ ID NO: 1817 - DNA, 20 bp, synthetic construct
  source 1..20: mol_type = other DNA
ttgtcatagttaagtaacag

SEQ ID NO: 1818 - DNA, 20 bp, synthetic construct
  source 1..20: mol_type = other DNA
aaacaagtaatacagtatac

SEQ ID NO: 1819 - DNA, 20 bp, synthetic construct
  source 1..20: mol_type = other DNA
atttcagatttacaacagag

SEQ ID NO: 1820 - DNA, 20 bp, synthetic construct
  source 1..20: mol_type = other DNA
tgttaaagcttgataatagg

SEQ ID NO: 1821 - DNA, 20 bp, synthetic construct
  source 1..20: mol_type = other DNA
agcaccaaattgttcctaac

SEQ ID NO: 1822 - DNA, 20 bp, synthetic construct
  source 1..20: mol_type = other DNA
agcacacataatctatataa

SEQ ID NO: 1823 - DNA, 20 bp, synthetic construct
  source 1..20: mol_type = other DNA
taccatctatcatcaataaa

SEQ ID NO: 1824 - DNA, 20 bp, synthetic construct
  source 1..20: mol_type = other DNA
ttctctgacaacaatgacaa

SEQ ID NO: 1825 - DNA, 20 bp, synthetic construct
  source 1..20: mol_type = other DNA
tgtctgcacagacacctgtt

SEQ ID NO: 1826 - DNA, 20 bp, synthetic construct
  source 1..20: mol_type = other DNA
gtatctcttaacccagagaa

SEQ ID NO: 1827 - DNA, 20 bp, synthetic construct
  source 1..20: mol_type = other DNA
tgtatctcttaacccagaga

SEQ ID NO: 1828 - DNA, 20 bp, synthetic construct
  source 1..20: mol_type = other DNA
atgtatctcttaacccagag

SEQ ID NO: 1829 - DNA, 20 bp, synthetic construct
  source 1..20: mol_type = other DNA
catgtatctcttaacccaga

SEQ ID NO: 1830 - DNA, 20 bp, synthetic construct
  source 1..20: mol_type = other DNA
tcatgtatctcttaacccag

SEQ ID NO: 1831 - DNA, 20 bp, synthetic construct
  source 1..20: mol_type = other DNA
tttcatgtatctcttaaccc

SEQ ID NO: 1832 - DNA, 20 bp, synthetic construct
  source 1..20: mol_type = other DNA
ttttcatgtatctcttaacc

SEQ ID NO: 1833 - DNA, 20 bp, synthetic construct
  source 1..20: mol_type = other DNA
gttttcatgtatctcttaac

SEQ ID NO: 1834 - DNA, 20 bp, synthetic construct
  source 1..20: mol_type = other DNA
tgttttcatgtatctcttaa

SEQ ID NO: 1835 - DNA, 20 bp, synthetic construct
  source 1..20: mol_type = other DNA
ctgttttcatgtatctctta

SEQ ID NO: 1836 - DNA, 20 bp, synthetic construct
  source 1..20: mol_type = other DNA
aaattaacttggtctttttc

SEQ ID NO: 1837 - DNA, 20 bp, synthetic construct
  source 1..20: mol_type = other DNA
tctgttgctcttagaatcta

SEQ ID NO: 1838 - DNA, 20 bp, synthetic construct
  source 1..20: mol_type = other DNA
atggaaccttgaacttggga

SEQ ID NO: 1839 - DNA, 20 bp, synthetic construct
  source 1..20: mol_type = other DNA
gattcagaaacacttttata

SEQ ID NO: 1840 - DNA, 20 bp, synthetic construct
  source 1..20: mol_type = other DNA
aagttgctttgagaattttc

SEQ ID NO: 1841 - DNA, 20 bp, synthetic construct
  source 1..20: mol_type = other DNA
aaatctagtccaacttcctc

SEQ ID NO: 1842 - DNA, 20 bp, synthetic construct
  source 1..20: mol_type = other DNA
actcattggtaatggattat

SEQ ID NO: 1843 - DNA, 20 bp, synthetic construct
  source 1..20: mol_type = other DNA
ttgcaatgtttcaatatgct

SEQ ID NO: 1844 - DNA, 20 bp, synthetic construct
  source 1..20: mol_type = other DNA
attgcaatgtttcaatatgc

SEQ ID NO: 1845 - DNA, 20 bp, synthetic construct
  source 1..20: mol_type = other DNA
gattgcaatgtttcaatatg

SEQ ID NO: 1846 - DNA, 20 bp, synthetic construct
  source 1..20: mol_type = other DNA
tgattgcaatgtttcaatat

SEQ ID NO: 1847 - DNA, 20 bp, synthetic construct
  source 1..20: mol_type = other DNA
ctgattgcaatgtttcaata

SEQ ID NO: 1848 - DNA, 20 bp, synthetic construct
  source 1..20: mol_type = other DNA
tgctgattgcaatgtttcaa

SEQ ID NO: 1849 - DNA, 20 bp, synthetic construct
  source 1..20: mol_type = other DNA
ttgctgattgcaatgtttca

SEQ ID NO: 1850 - DNA, 20 bp, synthetic construct
  source 1..20: mol_type = other DNA
attgctgattgcaatgtttc

SEQ ID NO: 1851 - DNA, 20 bp, synthetic construct
  source 1..20: mol_type = other DNA
aattgctgattgcaatgttt

SEQ ID NO: 1852 - DNA, 20 bp, synthetic construct
  source 1..20: mol_type = other DNA
taattgctgattgcaatgtt

SEQ ID NO: 1853 - DNA, 20 bp, synthetic construct
  source 1..20: mol_type = other DNA
aatcggaaatttaaattatc

SEQ ID NO: 1854 - DNA, 20 bp, synthetic construct
  source 1..20: mol_type = other DNA
ttagtgacctaacagctcgg

SEQ ID NO: 1855 - DNA, 20 bp, synthetic construct
  source 1..20: mol_type = other DNA
gtacagtatttattgaatca

SEQ ID NO: 1856 - DNA, 20 bp, synthetic construct
  source 1..20: mol_type = other DNA
atttatgctatcatgtagtt

SEQ ID NO: 1857 - DNA, 20 bp, synthetic construct
  source 1..20: mol_type = other DNA
aataatatattcccaggaaa

SEQ ID NO: 1858 - DNA, 20 bp, synthetic construct
  source 1..20: mol_type = other DNA
tagcaaccatgtggcctaga

SEQ ID NO: 1859 - DNA, 20 bp, synthetic construct
  source 1..20: mol_type = other DNA
actgtcaaaatctgaaagat

SEQ ID NO: 1860 - DNA, 20 bp, synthetic construct
  source 1..20: mol_type = other DNA
agttagtttgacaattaaaa

SEQ ID NO: 1861 - DNA, 20 bp, synthetic construct
  source 1..20: mol_type = other DNA
agtaactatacacataaagt

SEQ ID NO: 1862 - DNA, 20 bp, synthetic construct
  source 1..20: mol_type = other DNA
caccggatttgctctttttt

SEQ ID NO: 1863 - DNA, 20 bp, synthetic construct
  source 1..20: mol_type = other DNA
aatctactgcacacaacaca

SEQ ID NO: 1864 - DNA, 20 bp, synthetic construct
  source 1..20: mol_type = other DNA
aatggagccattaattatta

SEQ ID NO: 1865 - DNA, 20 bp, synthetic construct
  source 1..20: mol_type = other DNA
atttccttaccttttctaca

SEQ ID NO: 1866 - DNA, 20 bp, synthetic construct
  source 1..20: mol_type = other DNA
gctttaaggtaaagtttttt

SEQ ID NO: 1867 - DNA, 20 bp, synthetic construct
  source 1..20: mol_type = other DNA
gccagcattcaaaccctcaa

SEQ ID NO: 1868 - DNA, 20 bp, synthetic construct
  source 1..20: mol_type = other DNA
atgagagtagattttaatag

SEQ ID NO: 1869 - DNA, 20 bp, synthetic construct
  source 1..20: mol_type = other DNA
ctgagttccaaagcatttaa

SEQ ID NO: 1870 - DNA, 20 bp, synthetic construct
  source 1..20: mol_type = other DNA
cacattttaatgcaggaaaa

SEQ ID NO: 1871 - DNA, 20 bp, synthetic construct
  source 1..20: mol_type = other DNA
tggatataagtgaatacaca

SEQ ID NO: 1872 - DNA, 20 bp, synthetic construct
  source 1..20: mol_type = other DNA
atagtggcccctaaatcctt

SEQ ID NO: 1873 - DNA, 20 bp, synthetic construct
  source 1..20: mol_type = other DNA
tatagtggcccctaaatcct

SEQ ID NO: 1874 - DNA, 20 bp, synthetic construct
  source 1..20: mol_type = other DNA
atatagtggcccctaaatcc

SEQ ID NO: 1875 - DNA, 20 bp, synthetic construct
  source 1..20: mol_type = other DNA
catatagtggcccctaaatc

SEQ ID NO: 1876 - DNA, 20 bp, synthetic construct
  source 1..20: mol_type = other DNA
tcatatagtggcccctaaat

SEQ ID NO: 1877 - DNA, 20 bp, synthetic construct
  source 1..20: mol_type = other DNA
agtcatatagtggcccctaa

SEQ ID NO: 1878 - DNA, 20 bp, synthetic construct
  source 1..20: mol_type = other DNA
tagtcatatagtggccccta

SEQ ID NO: 1879 - DNA, 20 bp, synthetic construct
  source 1..20: mol_type = other DNA
atagtcatatagtggcccct

SEQ ID NO: 1880 - DNA, 20 bp, synthetic construct
  source 1..20: mol_type = other DNA
catagtcatatagtggcccc

SEQ ID NO: 1881 - DNA, 20 bp, synthetic construct
  source 1..20: mol_type = other DNA
ccatagtcatatagtggccc

SEQ ID NO: 1882 - DNA, 20 bp, synthetic construct
  source 1..20: mol_type = other DNA
cttccaactcattctctctc

SEQ ID NO: 1883 - DNA, 20 bp, synthetic construct
  source 1..20: mol_type = other DNA
gtggcctcagagctttctgc

SEQ ID NO: 1884 - DNA, 20 bp, synthetic construct
  source 1..20: mol_type = other DNA
tccactgtgtagcctcattt

SEQ ID NO: 1885 - DNA, 20 bp, synthetic construct
  source 1..20: mol_type = other DNA
aagccacatttattaccttt

SEQ ID NO: 1886 - DNA, 20 bp, synthetic construct
  source 1..20: mol_type = other DNA
gagaaataacacaaaacttt

SEQ ID NO: 1887 - DNA, 20 bp, synthetic construct
  source 1..20: mol_type = other DNA
ggcactgaaaagtcccaagt

SEQ ID NO: 1888 - DNA, 20 bp, synthetic construct
  source 1..20: mol_type = other DNA
agtaggaaataggataagca

SEQ ID NO: 1889 - DNA, 20 bp, synthetic construct
  source 1..20: mol_type = other DNA
ttaacatgtaaggactgaaa

SEQ ID NO: 1890 - DNA, 20 bp, synthetic construct
  source 1..20: mol_type = other DNA
tgatgacatatccaccacat

SEQ ID NO: 1891 - DNA, 20 bp, synthetic construct
  source 1..20: mol_type = other DNA
tttagcttactactatatat

SEQ ID NO: 1892 - DNA, 20 bp, synthetic construct
  source 1..20: mol_type = other DNA
taatgcaagtaatacaaaaa

SEQ ID NO: 1893 - DNA, 20 bp, synthetic construct
  source 1..20: mol_type = other DNA
ttctttaacaatcaatagag

SEQ ID NO: 1894 - DNA, 20 bp, synthetic construct
  source 1..20: mol_type = other DNA
tatggatgaaaagtgaacat

SEQ ID NO: 1895 - DNA, 20 bp, synthetic construct
  source 1..20: mol_type = other DNA
gaaattacctacacattaaa

SEQ ID NO: 1896 - DNA, 20 bp, synthetic construct
  source 1..20: mol_type = other DNA
gacatttttaatgtactaat

SEQ ID NO: 1897 - DNA, 20 bp, synthetic construct
  source 1..20: mol_type = other DNA
aattttctatcctggaaaag

SEQ ID NO: 1898 - DNA, 20 bp, synthetic construct
  source 1..20: mol_type = other DNA
agaaggagttaagttagctc

SEQ ID NO: 1899 - DNA, 20 bp, synthetic construct
  source 1..20: mol_type = other DNA
cagtgtagtcatactaacag

SEQ ID NO: 1900 - DNA, 20 bp, synthetic construct
  source 1..20: mol_type = other DNA
acagtgtagtcatactaaca

SEQ ID NO: 1901 - DNA, 20 bp, synthetic construct
  source 1..20: mol_type = other DNA
cacagtgtagtcatactaac

SEQ ID NO: 1902 - DNA, 20 bp, synthetic construct
  source 1..20: mol_type = other DNA
acacagtgtagtcatactaa

SEQ ID NO: 1903 - DNA, 20 bp, synthetic construct
  source 1..20: mol_type = other DNA
cacacagtgtagtcatacta

SEQ ID NO: 1904 - DNA, 20 bp, synthetic construct
  source 1..20: mol_type = other DNA
tgcacacagtgtagtcatac

SEQ ID NO: 1905 - DNA, 20 bp, synthetic construct
  source 1..20: mol_type = other DNA
gtgcacacagtgtagtcata

SEQ ID NO: 1906 - DNA, 20 bp, synthetic construct
  source 1..20: mol_type = other DNA
agtgcacacagtgtagtcat

SEQ ID NO: 1907 - DNA, 20 bp, synthetic construct
  source 1..20: mol_type = other DNA
cagtgcacacagtgtagtca

SEQ ID NO: 1908 - DNA, 20 bp, synthetic construct
  source 1..20: mol_type = other DNA
acagtgcacacagtgtagtc

SEQ ID NO: 1909 - DNA, 20 bp, synthetic construct
  source 1..20: mol_type = other DNA
cttgctttatggtaagaatg

SEQ ID NO: 1910 - DNA, 20 bp, synthetic construct
  source 1..20: mol_type = other DNA
caagtctggatcacacttgt

SEQ ID NO: 1911 - DNA, 20 bp, synthetic construct
  source 1..20: mol_type = other DNA
aaaatttgatcagggaaatg

SEQ ID NO: 1912 - DNA, 20 bp, synthetic construct
  source 1..20: mol_type = other DNA
gtggaatagtgatgaatccc

SEQ ID NO: 1913 - DNA, 20 bp, synthetic construct
  source 1..20: mol_type = other DNA
agactatttaaaaaatggga

SEQ ID NO: 1914 - DNA, 20 bp, synthetic construct
  source 1..20: mol_type = other DNA
cacagtaattctgaaggctt

SEQ ID NO: 1915 - DNA, 20 bp, synthetic construct
  source 1..20: mol_type = other DNA
ccttcccctactgtcaacac

SEQ ID NO: 1916 - DNA, 20 bp, synthetic construct
  source 1..20: mol_type = other DNA
ccccaggcactgttttcctt

SEQ ID NO: 1917 - DNA, 20 bp, synthetic construct
  source 1..20: mol_type = other DNA
gtttcagagaactagaataa

SEQ ID NO: 1918 - DNA, 20 bp, synthetic construct
  source 1..20: mol_type = other DNA
acttcatcagaaactgctgg

SEQ ID NO: 1919 - DNA, 20 bp, synthetic construct
  source 1..20: mol_type = other DNA
aaaattctgatttccaactc

SEQ ID NO: 1920 - DNA, 20 bp, synthetic construct
  source 1..20: mol_type = other DNA
gtatgttaaataagaattga

SEQ ID NO: 1921 - DNA, 20 bp, synthetic construct
  source 1..20: mol_type = other DNA
caatgtgatgcttgcatttt

SEQ ID NO: 1922 - DNA, 20 bp, synthetic construct
  source 1..20: mol_type = other DNA
tgacaccaaattagtcattt

SEQ ID NO: 1923 - DNA, 20 bp, synthetic construct
  source 1..20: mol_type = other DNA
tgtactcaaacatgtatata

SEQ ID NO: 1924 - DNA, 20 bp, synthetic construct
  source 1..20: mol_type = other DNA
ggtcacggccagccccctgt

SEQ ID NO: 1925 - DNA, 20 bp, synthetic construct
  source 1..20: mol_type = other DNA
aacatacactttgaagtgtt

SEQ ID NO: 1926 - DNA, 20 bp, synthetic construct
  source 1..20: mol_type = other DNA
gtttaggagagactatagaa

SEQ ID NO: 1927 - DNA, 20 bp, synthetic construct
  source 1..20: mol_type = other DNA
ggtttaggagagactataga

SEQ ID NO: 1928 - DNA, 20 bp, synthetic construct
  source 1..20: mol_type = other DNA
tggtttaggagagactatag

SEQ ID NO: 1929 - DNA, 20 bp, synthetic construct
  source 1..20: mol_type = other DNA
atggtttaggagagactata

SEQ ID NO: 1930 - DNA, 20 bp, synthetic construct
  source 1..20: mol_type = other DNA
tatggtttaggagagactat

SEQ ID NO: 1931 - DNA, 20 bp, synthetic construct
  source 1..20: mol_type = other DNA
catatggtttaggagagact

SEQ ID NO: 1932 - DNA, 20 bp, synthetic construct
  source 1..20: mol_type = other DNA
gcatatggtttaggagagac

SEQ ID NO: 1933 - DNA, 20 bp, synthetic construct
  source 1..20: mol_type = other DNA
tgcatatggtttaggagaga

SEQ ID NO: 1934 - DNA, 20 bp, synthetic construct
  source 1..20: mol_type = other DNA
ttgcatatggtttaggagag

SEQ ID NO: 1935 - DNA, 20 bp, synthetic construct
  source 1..20: mol_type = other DNA
gttgcatatggtttaggaga

SEQ ID NO: 1936 - DNA, 20 bp, synthetic construct
  source 1..20: mol_type = other DNA
tctatggaatttcatccttt

SEQ ID NO: 1937 - DNA, 20 bp, synthetic construct
  source 1..20: mol_type = other DNA
cagcaaaaccaggaagtcag

SEQ ID NO: 1938 - DNA, 20 bp, synthetic construct
  source 1..20: mol_type = other DNA
gtattgttgccaaatgaatg

SEQ ID NO: 1939 - DNA, 20 bp, synthetic construct
  source 1..20: mol_type = other DNA
tgtattgttgccaaatgaat

SEQ ID NO: 1940 - DNA, 20 bp, synthetic construct
  source 1..20: mol_type = other DNA
atgtattgttgccaaatgaa

SEQ ID NO: 1941 - DNA, 20 bp, synthetic construct
  source 1..20: mol_type = other DNA
aatgtattgttgccaaatga

SEQ ID NO: 1942 - DNA, 20 bp, synthetic construct
  source 1..20: mol_type = other DNA
caatgtattgttgccaaatg

SEQ ID NO: 1943 - DNA, 20 bp, synthetic construct
  source 1..20: mol_type = other DNA
ttcaatgtattgttgccaaa

SEQ ID NO: 1944 - DNA, 20 bp, synthetic construct
  source 1..20: mol_type = other DNA
gttcaatgtattgttgccaa

SEQ ID NO: 1945 - DNA, 20 bp, synthetic construct
  source 1..20: mol_type = other DNA
tgttcaatgtattgttgcca

SEQ ID NO: 1946 - DNA, 20 bp, synthetic construct
  source 1..20: mol_type = other DNA
atgttcaatgtattgttgcc

SEQ ID NO: 1947 - DNA, 20 bp, synthetic construct
  source 1..20: mol_type = other DNA
aatgttcaatgtattgttgc

SEQ ID NO: 1948 - DNA, 20 bp, synthetic construct
  source 1..20: mol_type = other DNA
cacatccttttacaatagtt

SEQ ID NO: 1949 - DNA, 20 bp, synthetic construct
  source 1..20: mol_type = other DNA
aggatggagacatcgaattt

SEQ ID NO: 1950 - DNA, 20 bp, synthetic construct
  source 1..20: mol_type = other DNA
aaggatggagacatcgaatt

SEQ ID NO: 1951 - DNA, 20 bp, synthetic construct
  source 1..20: mol_type = other DNA
gaaggatggagacatcgaat

SEQ ID NO: 1952 - DNA, 20 bp, synthetic construct
  source 1..20: mol_type = other DNA
ggaaggatggagacatcgaa

SEQ ID NO: 1953 - DNA, 20 bp, synthetic construct
  source 1..20: mol_type = other DNA
tggaaggatggagacatcga

SEQ ID NO: 1954 - DNA, 20 bp, synthetic construct
  source 1..20: mol_type = other DNA
gttggaaggatggagacatc

SEQ ID NO: 1955 - DNA, 20 bp, synthetic construct
  source 1..20: mol_type = other DNA
agttggaaggatggagacat

SEQ ID NO: 1956 - DNA, 20 bp, synthetic construct
  source 1..20: mol_type = other DNA
gagttggaaggatggagaca

SEQ ID NO: 1957 - DNA, 20 bp, synthetic construct
  source 1..20: mol_type = other DNA
agagttggaaggatggagac

SEQ ID NO: 1958 - DNA, 20 bp, synthetic construct
  source 1..20: mol_type = other DNA
aagagttggaaggatggaga

SEQ ID NO: 1959 - DNA, 20 bp, synthetic construct
  source 1..20: mol_type = other DNA
tggatagacagaaagttatc

SEQ ID NO: 1960 - DNA, 20 bp, synthetic construct
  source 1..20: mol_type = other DNA
tccaggacagtgttttaaaa

SEQ ID NO: 1961 - DNA, 20 bp, synthetic construct
  source 1..20: mol_type = other DNA
aatcttcattgtagagaaaa

SEQ ID NO: 1962 - DNA, 20 bp, synthetic construct
  source 1..20: mol_type = other DNA
gcggattttttaaaaagcct

SEQ ID NO: 1963 - DNA, 20 bp, synthetic construct
  source 1..20: mol_type = other DNA
taaaaagagacccaaataac

SEQ ID NO: 1964 - DNA, 20 bp, synthetic construct
  source 1..20: mol_type = other DNA
tttaattctgtctctgtgtg

SEQ ID NO: 1965 - DNA, 20 bp, synthetic construct
  source 1..20: mol_type = other DNA
gcttgagaagacctaagtaa

SEQ ID NO: 1966 - DNA, 20 bp, synthetic construct
  source 1..20: mol_type = other DNA
gatggtaacctaaattaaaa

SEQ ID NO: 1967 - DNA, 20 bp, synthetic construct
  source 1..20: mol_type = other DNA
agagctgtgacatggccacc

SEQ ID NO: 1968 - DNA, 20 bp, synthetic construct
  source 1..20: mol_type = other DNA
tctctagattctgtttttga

SEQ ID NO: 1969 - DNA, 20 bp, synthetic construct
  source 1..20: mol_type = other DNA
ctggaacccaactagatcac

SEQ ID NO: 1970 - DNA, 20 bp, synthetic construct
  source 1..20: mol_type = other DNA
tgattctaaagcaaaacaca

SEQ ID NO: 1971 - DNA, 20 bp, synthetic construct
  source 1..20: mol_type = other DNA
cttgcctggcagtgggaaaa

SEQ ID NO: 1972 - DNA, 20 bp, synthetic construct
  source 1..20: mol_type = other DNA
aatgaaagactggctccctt

SEQ ID NO: 1973 - DNA, 20 bp, synthetic construct
  source 1..20: mol_type = other DNA
gttcagagatgtgctattta

SEQ ID NO: 1974 - DNA, 20 bp, synthetic construct
  source 1..20: mol_type = other DNA
gcacaatatttatcttcagg

SEQ ID NO: 1975 - DNA, 20 bp, synthetic construct
  source 1..20: mol_type = other DNA
taatgttgaggcacaatatt

SEQ ID NO: 1976 - DNA, 20 bp, synthetic construct
  source 1..20: mol_type = other DNA
aaagatctgtaatttcccca

SEQ ID NO: 1977 - DNA, 20 bp, synthetic construct
  source 1..20: mol_type = other DNA
agcaatacaaatacagcata

SEQ ID NO: 1978 - DNA, 20 bp, synthetic construct
  source 1..20: mol_type = other DNA
gtaggtagaccaatgtagag

SEQ ID NO: 1979 - DNA, 20 bp, synthetic construct
  source 1..20: mol_type = other DNA
attaataaaatacctaggag

SEQ ID NO: 1980 - DNA, 20 bp, synthetic construct
  source 1..20: mol_type = other DNA
tactaagattacaatgagtt

SEQ ID NO: 1981 - DNA, 20 bp, synthetic construct
  source 1..20: mol_type = other DNA
ttcctacaatcaatacttaa

SEQ ID NO: 1982 - DNA, 20 bp, synthetic construct
  source 1..20: mol_type = other DNA
gaactatgatttatgctctt

SEQ ID NO: 1983 - DNA, 20 bp, synthetic construct
  source 1..20: mol_type = other DNA
attgcatcagattgatgtac

SEQ ID NO: 1984 - DNA, 20 bp, synthetic construct
  source 1..20: mol_type = other DNA
aaaaatcctcattcatggga

SEQ ID NO: 1985 - DNA, 20 bp, synthetic construct
  source 1..20: mol_type = other DNA
taaagcatctatgctccaaa

SEQ ID NO: 1986 - DNA, 20 bp, synthetic construct
  source 1..20: mol_type = other DNA
gcagacctagaactccaaaa

SEQ ID NO: 1987 - DNA, 20 bp, synthetic construct
  source 1..20: mol_type = other DNA
aacaacgaggaatatgtaaa

SEQ ID NO: 1988 - DNA, 20 bp, synthetic construct
  source 1..20: mol_type = other DNA
caaaatagaccaaccagtcc

SEQ ID NO: 1989 - DNA, 20 bp, synthetic construct
  source 1..20: mol_type = other DNA
catccaaacataaacagaaa

SEQ ID NO: 1990 - DNA, 20 bp, synthetic construct
  source 1..20: mol_type = other DNA
gttagccttttatacctaga

SEQ ID NO: 1991 - DNA, 20 bp, synthetic construct
  source 1..20: mol_type = other DNA
atctgtaacttttgaatgtt

SEQ ID NO: 1992 - DNA, 20 bp, synthetic construct
  source 1..20: mol_type = other DNA
ggtcttgatccccactcctt

SEQ ID NO: 1993 - DNA, 20 bp, synthetic construct
  source 1..20: mol_type = other DNA
tatcaaggagacctgttggc

SEQ ID NO: 1994 - DNA, 20 bp, synthetic construct
  source 1..20: mol_type = other DNA
aagttttacatgaagtctca

SEQ ID NO: 1995 - DNA, 20 bp, synthetic construct
  source 1..20: mol_type = other DNA
agctgttatgggaacccaaa

SEQ ID NO: 1996 - DNA, 20 bp, synthetic construct
  source 1..20: mol_type = other DNA
cgtccgctgctcagggaacc

SEQ ID NO: 1997 - DNA, 20 bp, synthetic construct
  source 1..20: mol_type = other DNA
aacgcacttaacaatatcat

SEQ ID NO: 1998 - DNA, 20 bp, synthetic construct
  source 1..20: mol_type = other DNA
atagcttccaccacaatatt

SEQ ID NO: 1999 - DNA, 20 bp, synthetic construct
  source 1..20: mol_type = other DNA
tttgatgaagaatgcatcag

SEQ ID NO: 2000 - DNA, 20 bp, synthetic construct
  source 1..20: mol_type = other DNA
cactttcagccacttcagga

SEQ ID NO: 2001 - DNA, 20 bp, synthetic construct
  source 1..20: mol_type = other DNA
aatatcattcttgaaacact

SEQ ID NO: 2002 - DNA, 20 bp, synthetic construct
  source 1..20: mol_type = other DNA
atccagggccagcctcctta

SEQ ID NO: 2003 - DNA, 20 bp, synthetic construct
  source 1..20: mol_type = other DNA
tgaagctccagcttttcaag

SEQ ID NO: 2004 - DNA, 20 bp, synthetic construct
  source 1..20: mol_type = other DNA
tctccactttaggacaagcc

SEQ ID NO: 2005 - DNA, 20 bp, synthetic construct
  source 1..20: mol_type = other DNA
gatgcagtttctctactcta

SEQ ID NO: 2006 - DNA, 20 bp, synthetic construct
  source 1..20: mol_type = other DNA
ggatgagtactatagaattc

SEQ ID NO: 2007 - DNA, 20 bp, synthetic construct
  source 1..20: mol_type = other DNA
ttccggtcaattacgggaaa

SEQ ID NO: 2008 - DNA, 20 bp, synthetic construct
  source 1..20: mol_type = other DNA
atctggaatttttctaggag

SEQ ID NO: 2009 - DNA, 20 bp, synthetic construct
  source 1..20: mol_type = other DNA
caggaaaccattcttccatg

SEQ ID NO: 2010 - DNA, 20 bp, synthetic construct
  source 1..20: mol_type = other DNA
gtttattaaaaatcttcaca

SEQ ID NO: 2011 - DNA, 20 bp, synthetic construct
  source 1..20: mol_type = other DNA
aatgcttgcattcctgctgt

SEQ ID NO: 2012 - DNA, 20 bp, synthetic construct
  source 1..20: mol_type = other DNA
tccacaacagggctattttg

SEQ ID NO: 2013 - DNA, 20 bp, synthetic construct
  source 1..20: mol_type = other DNA
aattcatttgaatatttaca

SEQ ID NO: 2014 - DNA, 20 bp, synthetic construct
  source 1..20: mol_type = other DNA
gttaaagcatagcttccttt

SEQ ID NO: 2015 - DNA, 20 bp, synthetic construct
  source 1..20: mol_type = other DNA
aatgaaggtggccagaatca

SEQ ID NO: 2016 - DNA, 20 bp, synthetic construct
  source 1..20: mol_type = other DNA
aagtgagtattaaaatgtca

SEQ ID NO: 2017 - DNA, 20 bp, synthetic construct
  source 1..20: mol_type = other DNA
caaaatgtaagttatcagaa

SEQ ID NO: 2018 - DNA, 20 bp, synthetic construct
  source 1..20: mol_type = other DNA
tcaataatgtttagttagtt

SEQ ID NO: 2019 - DNA, 20 bp, synthetic construct
  source 1..20: mol_type = other DNA
actatagtacatgtatctca

SEQ ID NO: 2020 - DNA, 20 bp, synthetic construct
  source 1..20: mol_type = other DNA
ttatacatgacagcctgaag

SEQ ID NO: 2021 - DNA, 20 bp, synthetic construct
  source 1..20: mol_type = other DNA
agaacacttattacatacca

SEQ ID NO: 2022 - DNA, 20 bp, synthetic construct
  source 1..20: mol_type = other DNA
tttttgacactccttttaaa

SEQ ID NO: 2023 - DNA, 20 bp, synthetic construct
  source 1..20: mol_type = other DNA
acgatcattccttattattc

SEQ ID NO: 2024 - DNA, 20 bp, synthetic construct
  source 1..20: mol_type = other DNA
ggcacgacaatattcattgt

SEQ ID NO: 2025 - DNA, 20 bp, synthetic construct
  source 1..20: mol_type = other DNA
caacctgctggctagtcacc

SEQ ID NO: 2026 - DNA, 20 bp, synthetic construct
  source 1..20: mol_type = other DNA
taattatacaaagctataag

SEQ ID NO: 2027 - DNA, 20 bp, synthetic construct
  source 1..20: mol_type = other DNA
atagaacattttacacacta

SEQ ID NO: 2028 - DNA, 20 bp, synthetic construct
  source 1..20: mol_type = other DNA
aaccgccagctatataatct

SEQ ID NO: 2029 - DNA, 20 bp, synthetic construct
  source 1..20: mol_type = other DNA
aggtgataacagatgtcagt

SEQ ID NO: 2030 - DNA, 20 bp, synthetic construct
  source 1..20: mol_type = other DNA
agtaatagattgaaagaaac

SEQ ID NO: 2031 - DNA, 20 bp, synthetic construct
  source 1..20: mol_type = other DNA
ttaatagtataaatacagaa

SEQ ID NO: 2032 - DNA, 20 bp, synthetic construct
  source 1..20: mol_type = other DNA
ccgactgctgaggttacacc

SEQ ID NO: 2033 - DNA, 20 bp, synthetic construct
  source 1..20: mol_type = other DNA
gtgagggagaggacataaag

SEQ ID NO: 2034 - DNA, 20 bp, synthetic construct
  source 1..20: mol_type = other DNA
tgtattacataggtatgact

SEQ ID NO: 2035 - DNA, 20 bp, synthetic construct
  source 1..20: mol_type = other DNA
ctttaaagatgcagaaataa

SEQ ID NO: 2036 - DNA, 20 bp, synthetic construct
  source 1..20: mol_type = other DNA
ttacccgtgcatgcacctgt

SEQ ID NO: 2037 - DNA, 20 bp, synthetic construct
  source 1..20: mol_type = other DNA
atattaaatacagtaaggtt

SEQ ID NO: 2038 - DNA, 20 bp, synthetic construct
  source 1..20: mol_type = other DNA
ccattcactccttactttgt

SEQ ID NO: 2039 - DNA, 20 bp, synthetic construct
  source 1..20: mol_type = other DNA
aaagataaaaatagtgtcag

SEQ ID NO: 2040 - DNA, 20 bp, synthetic construct
  source 1..20: mol_type = other DNA
ctcaagtttttccagatgat

SEQ ID NO: 2041 - DNA, 20 bp, synthetic construct
  source 1..20: mol_type = other DNA
aggtttcttaagtgggatac

SEQ ID NO: 2042 - DNA, 20 bp, synthetic construct
  source 1..20: mol_type = other DNA
gcttagagacaaattaaggg

SEQ ID NO: 2043 - DNA, 20 bp, synthetic construct
  source 1..20: mol_type = other DNA
ttatatataaattcgaaaga

SEQ ID NO: 2044 - DNA, 20 bp, synthetic construct
  source 1..20: mol_type = other DNA
tcagatctgtttccattgcc

SEQ ID NO: 2045 - DNA, 20 bp, synthetic construct
  source 1..20: mol_type = other DNA
caatttctaattttataatg

SEQ ID NO: 2046 - DNA, 20 bp, synthetic construct
  source 1..20: mol_type = other DNA
atttcctctattatttcata

SEQ ID NO: 2047 - DNA, 20 bp, synthetic construct
  source 1..20: mol_type = other DNA
aatacagtatacaggccagt

SEQ ID NO: 2048 - DNA, 20 bp, synthetic construct
  source 1..20: mol_type = other DNA
cattacctttcttgatttat

SEQ ID NO: 2049 - DNA, 20 bp, synthetic construct
  source 1..20: mol_type = other DNA
tttcctttcccatcttcatg

SEQ ID NO: 2050 - DNA, 20 bp, synthetic construct
  source 1..20: mol_type = other DNA
gaggacaaaaaatgatctct

SEQ ID NO: 2051 - DNA, 20 bp, synthetic construct
  source 1..20: mol_type = other DNA
ctaaatttgttttcttatga

SEQ ID NO: 2052 - DNA, 20 bp, synthetic construct
  source 1..20: mol_type = other DNA
accagggaggcaatatagaa

SEQ ID NO: 2053 - DNA, 20 bp, synthetic construct
  source 1..20: mol_type = other DNA
ccacatggagaagcaccaat

SEQ ID NO: 2054 - DNA, 20 bp, synthetic construct
  source 1..20: mol_type = other DNA
aaagtcaatgaaggtaatca

SEQ ID NO: 2055 - DNA, 20 bp, synthetic construct
  source 1..20: mol_type = other DNA
attaaggcaaatacaaagat

SEQ ID NO: 2056 - DNA, 20 bp, synthetic construct
  source 1..20: mol_type = other DNA
gctgcattaatatggagtat

SEQ ID NO: 2057 - DNA, 20 bp, synthetic construct
  source 1..20: mol_type = other DNA
tgcccttccaactcaatcac

SEQ ID NO: 2058 - DNA, 20 bp, synthetic construct
  source 1..20: mol_type = other DNA
ttatagataaaacttgaaga

SEQ ID NO: 2059 - DNA, 20 bp, synthetic construct
  source 1..20: mol_type = other DNA
atgctttaaactgtgattgc

SEQ ID NO: 2060 - DNA, 20 bp, synthetic construct
  source 1..20: mol_type = other DNA
ttaagatgatgggttctaga

SEQ ID NO: 2061 - DNA, 20 bp, synthetic construct
  source 1..20: mol_type = other DNA
tgcaagaaacacaagttgga

SEQ ID NO: 2062 - DNA, 20 bp, synthetic construct
  source 1..20: mol_type = other DNA
atgcacaggaaatcttattc

SEQ ID NO: 2063 - DNA, 20 bp, synthetic construct
  source 1..20: mol_type = other DNA
atattggagattaaaaggga

SEQ ID NO: 2064 - DNA, 20 bp, synthetic construct
  source 1..20: mol_type = other DNA
tttacaaacgacataatcct

SEQ ID NO: 2065 - DNA, 20 bp, synthetic construct
  source 1..20: mol_type = other DNA
agacccaaataacgatttaa

SEQ ID NO: 2066 - DNA, 20 bp, synthetic construct
  source 1..20: mol_type = other DNA
ccaaatcaagagctcacaac

SEQ ID NO: 2067 - DNA, 20 bp, synthetic construct
  source 1..20: mol_type = other DNA
tagtactttttttccaatac

SEQ ID NO: 2068 - DNA, 20 bp, synthetic construct
  source 1..20: mol_type = other DNA
agatattcatgctcacagac

SEQ ID NO: 2069 - DNA, 20 bp, synthetic construct
  source 1..20: mol_type = other DNA
tgttgtcagagagccactac

SEQ ID NO: 2070 - DNA, 20 bp, synthetic construct
  source 1..20: mol_type = other DNA
gaagcattacaaattttttt

SEQ ID NO: 2071 - DNA, 20 bp, synthetic construct
  source 1..20: mol_type = other DNA
ccaaagtacatacaattcaa

SEQ ID NO: 2072 - DNA, 20 bp, synthetic construct
  source 1..20: mol_type = other DNA
tttccttcctggacattgtt

SEQ ID NO: 2073 - DNA, 20 bp, synthetic construct
  source 1..20: mol_type = other DNA
taacgcacttaacaatatca

SEQ ID NO: 2074 - DNA, 20 bp, synthetic construct
  source 1..20: mol_type = other DNA
tcatagcttccaccacaata

SEQ ID NO: 2075 - DNA, 20 bp, synthetic construct
  source 1..20: mol_type = other DNA
cttcctttgatgaagaatgc

SEQ ID NO: 2076 - DNA, 20 bp, synthetic construct
  source 1..20: mol_type = other DNA
ccactttcagccacttcagg

SEQ ID NO: 2077 - DNA, 20 bp, synthetic construct
  source 1..20: mol_type = other DNA
gaatccatagcaccttccag

SEQ ID NO: 2078 - DNA, 20 bp, synthetic construct
  source 1..20: mol_type = other DNA
tatacaaaatcctccaaggc

SEQ ID NO: 2079 - DNA, 20 bp, synthetic construct
  source 1..20: mol_type = other DNA
ttcacatagctgttgtggaa

SEQ ID NO: 2080 - DNA, 20 bp, synthetic construct
  source 1..20: mol_type = other DNA
gaaactctccactttaggac

SEQ ID NO: 2081 - DNA, 20 bp, synthetic construct
  source 1..20: mol_type = other DNA
gggatgagtactatagaatt

SEQ ID NO: 2082 - DNA, 20 bp, synthetic construct
  source 1..20: mol_type = other DNA
tttccggtcaattacgggaa

SEQ ID NO: 2083 - DNA, 20 bp, synthetic construct
  source 1..20: mol_type = other DNA
caatctggaatttttctagg

SEQ ID NO: 2084 - DNA, 20 bp, synthetic construct
  source 1..20: mol_type = other DNA
agagtttctccttcaccaca

SEQ ID NO: 2085 - DNA, 20 bp, synthetic construct
  source 1..20: mol_type = other DNA
aaagcaccacaagctcttgt

SEQ ID NO: 2086 - DNA, 20 bp, synthetic construct
  source 1..20: mol_type = other DNA
caaatgcttgcattcctgct

SEQ ID NO: 2087 - DNA, 20 bp, synthetic construct
  source 1..20: mol_type = other DNA
tattagtccacagagttttt

SEQ ID NO: 2088 - DNA, 20 bp, synthetic construct
  source 1..20: mol_type = other DNA
gaagttgtgtaagatgcact

SEQ ID NO: 2089 - DNA, 20 bp, synthetic construct
  source 1..20: mol_type = other DNA
gagctctattatatatgatt

SEQ ID NO: 2090 - DNA, 20 bp, synthetic construct
  source 1..20: mol_type = other DNA
ttatctagaccctgcagacc

SEQ ID NO: 2091 - DNA, 20 bp, synthetic construct
  source 1..20: mol_type = other DNA
gaaggaaaaatactactttt

SEQ ID NO: 2092 - DNA, 20 bp, synthetic construct
  source 1..20: mol_type = other DNA
agttttagaggttgtaccaa

SEQ ID NO: 2093 - DNA, 20 bp, synthetic construct
  source 1..20: mol_type = other DNA
gtagtgggccggtggccgtt

SEQ ID NO: 2094 - DNA, 20 bp, synthetic construct
  source 1..20: mol_type = other DNA
gcttaattgctctacagtcc

SEQ ID NO: 2095 - DNA, 20 bp, synthetic construct
  source 1..20: mol_type = other DNA
atcctaattgtcatcgaaag

SEQ ID NO: 2096 - DNA, 20 bp, synthetic construct
  source 1..20: mol_type = other DNA
ataaaatacatattgtctaa

SEQ ID NO: 2097 - DNA, 20 bp, synthetic construct
  source 1..20: mol_type = other DNA
tatagaactacatctataaa

SEQ ID NO: 2098 - DNA, 20 bp, synthetic construct
  source 1..20: mol_type = other DNA
tacaagttgctacaatggag

SEQ ID NO: 2099 - DNA, 20 bp, synthetic construct
  source 1..20: mol_type = other DNA
atgtcatgtctgtgacacac

SEQ ID NO: 2100 - DNA, 20 bp, synthetic construct
  source 1..20: mol_type = other DNA
ttatgatgtttgaatggcac

SEQ ID NO: 2101 - DNA, 20 bp, synthetic construct
  source 1..20: mol_type = other DNA
attttttgccctctaaaaat

SEQ ID NO: 2102 - DNA, 20 bp, synthetic construct
  source 1..20: mol_type = other DNA
cccagcaaatgctgctggtc

SEQ ID NO: 2103 - DNA, 20 bp, synthetic construct
  source 1..20: mol_type = other DNA
tgtgccaattatttttttta

SEQ ID NO: 2104 - DNA, 20 bp, synthetic construct
  source 1..20: mol_type = other DNA
aatacagacataggtgtttt

SEQ ID NO: 2105 - DNA, 20 bp, synthetic construct
  source 1..20: mol_type = other DNA
ttcttaaagaatttcacatt

SEQ ID NO: 2106 - DNA, 20 bp, synthetic construct
  source 1..20: mol_type = other DNA
tttcacttcccacatcccca

SEQ ID NO: 2107 - DNA, 20 bp, synthetic construct
  source 1..20: mol_type = other DNA
cacagcacttacttgctctc

SEQ ID NO: 2108 - DNA, 20 bp, synthetic construct
  source 1..20: mol_type = other DNA
aattccaggaaccacaaact

SEQ ID NO: 2109 - DNA, 20 bp, synthetic construct
  source 1..20: mol_type = other DNA
tcagtacaggttaatgatga

SEQ ID NO: 2110 - DNA, 20 bp, synthetic construct
  source 1..20: mol_type = other DNA
cagcttcatgtaataggttt

SEQ ID NO: 2111 - DNA, 20 bp, synthetic construct
  source 1..20: mol_type = other DNA
cctctaatattacatattaa

SEQ ID NO: 2112 - DNA, 20 bp, synthetic construct
  source 1..20: mol_type = other DNA
aatccataggcaagtgggat

SEQ ID NO: 2113 - DNA, 20 bp, synthetic construct
  source 1..20: mol_type = other DNA
accatttctcctcccggctc

SEQ ID NO: 2114 - DNA, 20 bp, synthetic construct
  source 1..20: mol_type = other DNA
aaaagataaaaatagtgtca

SEQ ID NO: 2115 - DNA, 20 bp, synthetic construct
  source 1..20: mol_type = other DNA
ttccttgacccatcacttta

SEQ ID NO: 2116 - DNA, 20 bp, synthetic construct
  source 1..20: mol_type = other DNA
aaggtttcttaagtgggata

SEQ ID NO: 2117 - DNA, 20 bp, synthetic construct
  source 1..20: mol_type = other DNA
tggccttctgcttagagaca

SEQ ID NO: 2118 - DNA, 20 bp, synthetic construct
  source 1..20: mol_type = other DNA
actactttttataactaaat

SEQ ID NO: 2119 - DNA, 20 bp, synthetic construct
  source 1..20: mol_type = other DNA
atcagatctgtttccattgc

SEQ ID NO: 2120 - DNA, 20 bp, synthetic construct
  source 1..20: mol_type = other DNA
tttgaattaatgatttaaca

SEQ ID NO: 2121 - DNA, 20 bp, synthetic construct
  source 1..20: mol_type = other DNA
gaattcctgtttattgtcat

SEQ ID NO: 2122 - DNA, 20 bp, synthetic construct
  source 1..20: mol_type = other DNA
agctgaaaaacaagtaatac

SEQ ID NO: 2123 - DNA, 20 bp, synthetic construct
  source 1..20: mol_type = other DNA
aattagagaaaaagactaaa

SEQ ID NO: 2124 - DNA, 20 bp, synthetic construct
  source 1..20: mol_type = other DNA
aagaaaagaacaactgtcct

SEQ ID NO: 2125 - DNA, 20 bp, synthetic construct
  source 1..20: mol_type = other DNA
agaggacaaaaaatgatctc

SEQ ID NO: 2126 - DNA, 20 bp, synthetic construct
  source 1..20: mol_type = other DNA
acattatgaatgtcatttga

SEQ ID NO: 2127 - DNA, 20 bp, synthetic construct
  source 1..20: mol_type = other DNA
tcctgattaacattctttaa

SEQ ID NO: 2128 - DNA, 20 bp, synthetic construct
  source 1..20: mol_type = other DNA
atctgcttcatttctcttgg

SEQ ID NO: 2129 - DNA, 20 bp, synthetic construct
  source 1..20: mol_type = other DNA
gcaaatgattttactgctta

SEQ ID NO: 2130 - DNA, 20 bp, synthetic construct
  source 1..20: mol_type = other DNA
cttatttgcctcccatatcc

SEQ ID NO: 2131 - DNA, 20 bp, synthetic construct
  source 1..20: mol_type = other DNA
tttttaaagcccttctctat

SEQ ID NO: 2132 - DNA, 20 bp, synthetic construct
  source 1..20: mol_type = other DNA
ctacacttccaactttgtgt

SEQ ID NO: 2133 - DNA, 20 bp, synthetic construct
  source 1..20: mol_type = other DNA
gaaacctgtaagagacagtc

SEQ ID NO: 2134 - DNA, 20 bp, synthetic construct
  source 1..20: mol_type = other DNA
gtgtgatgttaaattgattc

SEQ ID NO: 2135 - DNA, 20 bp, synthetic construct
  source 1..20: mol_type = other DNA
catttttatagaaggcagat

SEQ ID NO: 2136 - DNA, 20 bp, synthetic construct
  source 1..20: mol_type = other DNA
actctcctactagactgtaa

SEQ ID NO: 2137 - DNA, 20 bp, synthetic construct
  source 1..20: mol_type = other DNA
attctcttctttttattcag

SEQ ID NO: 2138 - DNA, 20 bp, synthetic construct
  source 1..20: mol_type = other DNA
attaggccctgggtttctga

SEQ ID NO: 2139 - DNA, 20 bp, synthetic construct
  source 1..20: mol_type = other DNA
aagataaaacatatccctaa

SEQ ID NO: 2140 - DNA, 20 bp, synthetic construct
  source 1..20: mol_type = other DNA
tttatgtaaatttacttgtc

SEQ ID NO: 2141 - DNA, 20 bp, synthetic construct
  source 1..20: mol_type = other DNA
taaagtcattatagttgtac

SEQ ID NO: 2142 - DNA, 20 bp, synthetic construct
  source 1..20: mol_type = other DNA
aaaaaacaggcttcacattt

SEQ ID NO: 2143 - DNA, 20 bp, synthetic construct
  source 1..20: mol_type = other DNA
atctctataaggaaacctga

SEQ ID NO: 2144 - DNA, 20 bp, synthetic construct
  source 1..20: mol_type = other DNA
tttaacaatcattagtatat

SEQ ID NO: 2145 - DNA, 20 bp, synthetic construct
  source 1..20: mol_type = other DNA
gagaacattctttgtaatac

SEQ ID NO: 2146 - DNA, 20 bp, synthetic construct
  source 1..20: mol_type = other DNA
tgagaagaactggatgttca

SEQ ID NO: 2147 - DNA, 20 bp, synthetic construct
  source 1..20: mol_type = other DNA
agacgatcaacagaggcaca

SEQ ID NO: 2148 - DNA, 20 bp, synthetic construct
  source 1..20: mol_type = other DNA
gttaacgcacttaacaatat

SEQ ID NO: 2149 - DNA, 20 bp, synthetic construct
  source 1..20: mol_type = other DNA
ttcatagcttccaccacaat

SEQ ID NO: 2150 - DNA, 20 bp, synthetic construct
  source 1..20: mol_type = other DNA
tttctgaaattaacattttg

SEQ ID NO: 2151 - DNA, 20 bp, synthetic construct
  source 1..20: mol_type = other DNA
agccactttcagccacttca

SEQ ID NO: 2152 - DNA, 20 bp, synthetic construct
  source 1..20: mol_type = other DNA
ctgaatccatagcaccttcc

SEQ ID NO: 2153 - DNA, 20 bp, synthetic construct
  source 1..20: mol_type = other DNA
tttcctatacaaaatcctcc

SEQ ID NO: 2154 - DNA, 20 bp, synthetic construct
  source 1..20: mol_type = other DNA
aaactcttcagagtttcaca

SEQ ID NO: 2155 - DNA, 20 bp, synthetic construct
  source 1..20: mol_type = other DNA
caagaaaggcatagcagcaa

SEQ ID NO: 2156 - DNA, 20 bp, synthetic construct
  source 1..20: mol_type = other DNA
aagatgcagtttctctactc

SEQ ID NO: 2157 - DNA, 20 bp, synthetic construct
  source 1..20: mol_type = other DNA
ttcagcctgtcccttgctga

SEQ ID NO: 2158 - DNA, 20 bp, synthetic construct
  source 1..20: mol_type = other DNA
cgtttccggtcaattacggg

SEQ ID NO: 2159 - DNA, 20 bp, synthetic construct
  source 1..20: mol_type = other DNA
gggaagctctatcacaggcc

SEQ ID NO: 2160 - DNA, 20 bp, synthetic construct
  source 1..20: mol_type = other DNA
tataatgcccatttcttcaa

SEQ ID NO: 2161 - DNA, 20 bp, synthetic construct
  source 1..20: mol_type = other DNA
gtggcaaagcaccacaagct

SEQ ID NO: 2162 - DNA, 20 bp, synthetic construct
  source 1..20: mol_type = other DNA
ccaaatgcttgcattcctgc

SEQ ID NO: 2163 - DNA, 20 bp, synthetic construct
  source 1..20: mol_type = other DNA
ttttgtgttttgattccttg

SEQ ID NO: 2164 - DNA, 20 bp, synthetic construct
  source 1..20: mol_type = other DNA
tttcattagtacttttaatg

SEQ ID NO: 2165 - DNA, 20 bp, synthetic construct
  source 1..20: mol_type = other DNA
aaattgcaaatacaaagtaa

SEQ ID NO: 2166 - DNA, 20 bp, synthetic construct
  source 1..20: mol_type = other DNA
ctgggttgtcaagtatagca

SEQ ID NO: 2167 - DNA, 20 bp, synthetic construct
  source 1..20: mol_type = other DNA
tatcatgttaaatggcatct

SEQ ID NO: 2168 - DNA, 20 bp, synthetic construct
  source 1..20: mol_type = other DNA
catataatttctaaattatg

SEQ ID NO: 2169 - DNA, 20 bp, synthetic construct
  source 1..20: mol_type = other DNA
gttgatatattaaaatatag

SEQ ID NO: 2170 - DNA, 20 bp, synthetic construct
  source 1..20: mol_type = other DNA
attctcatctagaatgcaaa

SEQ ID NO: 2171 - DNA, 20 bp, synthetic construct
  source 1..20: mol_type = other DNA
tactctacatttatagtcat

SEQ ID NO: 2172 - DNA, 20 bp, synthetic construct
  source 1..20: mol_type = other DNA
gaaggctcacaccttcagat

SEQ ID NO: 2173 - DNA, 20 bp, synthetic construct
  source 1..20: mol_type = other DNA
tatacaacatttaagttgga

SEQ ID NO: 2174 - DNA, 20 bp, synthetic construct
  source 1..20: mol_type = other DNA
catctgtgtataaatatgta

SEQ ID NO: 2175 - DNA, 20 bp, synthetic construct
  source 1..20: mol_type = other DNA
ctgattccctctcatgtcat

SEQ ID NO: 2176 - DNA, 20 bp, synthetic construct
  source 1..20: mol_type = other DNA
actccttgctacagcttgta

SEQ ID NO: 2177 - DNA, 20 bp, synthetic construct
  source 1..20: mol_type = other DNA
ggtgagatgaaaaaggagga

SEQ ID NO: 2178 - DNA, 20 bp, synthetic construct
  source 1..20: mol_type = other DNA
ctgtttatcaagttccccca

SEQ ID NO: 2179 - DNA, 20 bp, synthetic construct
  source 1..20: mol_type = other DNA
gttttcactgcaacttctgt

SEQ ID NO: 2180 - DNA, 20 bp, synthetic construct
  source 1..20: mol_type = other DNA
taaatgtgttggatgaatac

SEQ ID NO: 2181 - DNA, 20 bp, synthetic construct
  source 1..20: mol_type = other DNA
tagagtttcatatccctttg

SEQ ID NO: 2182 - DNA, 20 bp, synthetic construct
  source 1..20: mol_type = other DNA
gagtggatttatgttactgg

SEQ ID NO: 2183 - DNA, 20 bp, synthetic construct
  source 1..20: mol_type = other DNA
ccacatcacagcacttactt

SEQ ID NO: 2184 - DNA, 20 bp, synthetic construct
  source 1..20: mol_type = other DNA
catagtctgtaggtagtagt

SEQ ID NO: 2185 - DNA, 20 bp, synthetic construct
  source 1..20: mol_type = other DNA
cgttaataattttcaaacaa

SEQ ID NO: 2186 - DNA, 20 bp, synthetic construct
  source 1..20: mol_type = other DNA
cttgaccagtaaaacgcaat

SEQ ID NO: 2187 - DNA, 20 bp, synthetic construct
  source 1..20: mol_type = other DNA
cagagtctgtcctcttcact

SEQ ID NO: 2188 - DNA, 20 bp, synthetic construct
  source 1..20: mol_type = other DNA
gtttatgtgattttaattca

SEQ ID NO: 2189 - DNA, 20 bp, synthetic construct
  source 1..20: mol_type = other DNA
aagcactacagagctctgat

SEQ ID NO: 2190 - DNA, 20 bp, synthetic construct
  source 1..20: mol_type = other DNA
ctgaccaaaactggtgtttt

SEQ ID NO: 2191 - DNA, 20 bp, synthetic construct
  source 1..20: mol_type = other DNA
tttcctggaatattaaccat

SEQ ID NO: 2192 - DNA, 20 bp, synthetic construct
  source 1..20: mol_type = other DNA
aaaaggtttcttaagtggga

SEQ ID NO: 2193 - DNA, 20 bp, synthetic construct
  source 1..20: mol_type = other DNA
ctggccttctgcttagagac

SEQ ID NO: 2194 - DNA, 20 bp, synthetic construct
  source 1..20: mol_type = other DNA
atataatttctcattaacca

SEQ ID NO: 2195 - DNA, 20 bp, synthetic construct
  source 1..20: mol_type = other DNA
taatcagatctgtttccatt

SEQ ID NO: 2196 - DNA, 20 bp, synthetic construct
  source 1..20: mol_type = other DNA
tatttgaattaatgatttaa

SEQ ID NO: 2197 - DNA, 20 bp, synthetic construct
  source 1..20: mol_type = other DNA
tattctctatgaaggaagat

SEQ ID NO: 2198 - DNA, 20 bp, synthetic construct
  source 1..20: mol_type = other DNA
gacaaacaaattatcaattt

SEQ ID NO: 2199 - DNA, 20 bp, synthetic construct
  source 1..20: mol_type = other DNA
tcttttacatgtcacactat

SEQ ID NO: 2200 - DNA, 20 bp, synthetic construct
  source 1..20: mol_type = other DNA
tgttgatatttgctttccgt

SEQ ID NO: 2201 - DNA, 20 bp, synthetic construct
  source 1..20: mol_type = other DNA
tgaaaaataaatgagaggac

SEQ ID NO: 2202 - DNA, 20 bp, synthetic construct
  source 1..20: mol_type = other DNA
gagaattttcatctttgaga

SEQ ID NO: 2203 - DNA, 20 bp, synthetic construct
  source 1..20: mol_type = other DNA
ttatttgtccccatacatga

SEQ ID NO: 2204 - DNA, 20 bp, synthetic construct
  source 1..20: mol_type = other DNA
gtagcagaattaatattttt

SEQ ID NO: 2205 - DNA, 20 bp, synthetic construct
  source 1..20: mol_type = other DNA
ccaaccttgttgagcaaatg

SEQ ID NO: 2206 - DNA, 20 bp, synthetic construct
  source 1..20: mol_type = other DNA
cacctgaaaactgtcttatt

SEQ ID NO: 2207 - DNA, 20 bp, synthetic construct
  source 1..20: mol_type = other DNA
actggaatcagaaatagaat

SEQ ID NO: 2208 - DNA, 20 bp, synthetic construct
  source 1..20: mol_type = other DNA
aattaagctgtccaagcgaa

SEQ ID NO: 2209 - DNA, 20 bp, synthetic construct
  source 1..20: mol_type = other DNA
tgaatgtgaagaatgcccat

SEQ ID NO: 2210 - DNA, 20 bp, synthetic construct
  source 1..20: mol_type = other DNA
tagcttgtgtgatgttaaat

SEQ ID NO: 2211 - DNA, 20 bp, synthetic construct
  source 1..20: mol_type = other DNA
gactcatctttcctcattgg

SEQ ID NO: 2212 - DNA, 20 bp, synthetic construct
  source 1..20: mol_type = other DNA
tgactctcctactagactgt

SEQ ID NO: 2213 - DNA, 20 bp, synthetic construct
  source 1..20: mol_type = other DNA
cattctcttctttttattca

SEQ ID NO: 2214 - DNA, 20 bp, synthetic construct
  source 1..20: mol_type = other DNA
aaaagattaggccctgggtt

SEQ ID NO: 2215 - DNA, 20 bp, synthetic construct
  source 1..20: mol_type = other DNA
attatacatttccttagaat

SEQ ID NO: 2216 - DNA, 20 bp, synthetic construct
  source 1..20: mol_type = other DNA
tatttatgtaaatttacttg

SEQ ID NO: 2217 - DNA, 20 bp, synthetic construct
  source 1..20: mol_type = other DNA
atttttactgtggacataaa

SEQ ID NO: 2218 - DNA, 20 bp, synthetic construct
  source 1..20: mol_type = other DNA
ggtacaaaaaacaggcttca

SEQ ID NO: 2219 - DNA, 20 bp, synthetic construct
  source 1..20: mol_type = other DNA
aacaaagatgatgaacgatc

SEQ ID NO: 2220 - DNA, 20 bp, synthetic construct
  source 1..20: mol_type = other DNA
atgaatgaacaacgaggaat

SEQ ID NO: 2221 - DNA, 20 bp, synthetic construct
  source 1..20: mol_type = other DNA
tgtgacagaactatgtcaaa

SEQ ID NO: 2222 - DNA, 20 bp, synthetic construct
  source 1..20: mol_type = other DNA
aatatagcatagtaattgag

SEQ ID NO: 2223 - DNA, 20 bp, synthetic construct
  source 1..20: mol_type = other DNA
gtccaagacgatcaacagag

SEQ ID NO: 2224 - DNA, 20 bp, synthetic construct
  source 1..20: mol_type = other DNA
agggaatgtaaacaatgcag

SEQ ID NO: 2225 - DNA, 20 bp, synthetic construct
  source 1..20: mol_type = other DNA
tttcatagcttccaccacaa

SEQ ID NO: 2226 - DNA, 20 bp, synthetic construct
  source 1..20: mol_type = other DNA
gtatttttctgaaattaaca

SEQ ID NO: 2227 - DNA, 20 bp, synthetic construct
  source 1..20: mol_type = other DNA
cagccactttcagccacttc

SEQ ID NO: 2228 - DNA, 20 bp, synthetic construct
  source 1..20: mol_type = other DNA
ttctttgtaatcaagtatcc

SEQ ID NO: 2229 - DNA, 20 bp, synthetic construct
  source 1..20: mol_type = other DNA
ccaagccaagaaggttcaac

SEQ ID NO: 2230 - DNA, 20 bp, synthetic construct
  source 1..20: mol_type = other DNA
tcaaactcttcagagtttca

SEQ ID NO: 2231 - DNA, 20 bp, synthetic construct
  source 1..20: mol_type = other DNA
ggaggcaagaaaggcatagc

SEQ ID NO: 2232 - DNA, 20 bp, synthetic construct
  source 1..20: mol_type = other DNA
gaaagatgcagtttctctac

SEQ ID NO: 2233 - DNA, 20 bp, synthetic construct
  source 1..20: mol_type = other DNA
tcaacttcagcctgtccctt

SEQ ID NO: 2234 - DNA, 20 bp, synthetic construct
  source 1..20: mol_type = other DNA
ttttctctcactagttgtaa

SEQ ID NO: 2235 - DNA, 20 bp, synthetic construct
  source 1..20: mol_type = other DNA
tttcatatagtcggatgata

SEQ ID NO: 2236 - DNA, 20 bp, synthetic construct
  source 1..20: mol_type = other DNA
gttcttcaccatcattaaaa

SEQ ID NO: 2237 - DNA, 20 bp, synthetic construct
  source 1..20: mol_type = other DNA
aagcaggcgatccaaggaac

SEQ ID NO: 2238 - DNA, 20 bp, synthetic construct
  source 1..20: mol_type = other DNA
aaatgagagctgtcctctgt

SEQ ID NO: 2239 - DNA, 20 bp, synthetic construct
  source 1..20: mol_type = other DNA
agagggttttcactctccca

SEQ ID NO: 2240 - DNA, 20 bp, synthetic construct
  source 1..20: mol_type = other DNA
tgttttttcattagtacttt

SEQ ID NO: 2241 - DNA, 20 bp, synthetic construct
  source 1..20: mol_type = other DNA
aatatggtattcattttttt

SEQ ID NO: 2242 - DNA, 20 bp, synthetic construct
  source 1..20: mol_type = other DNA
atgctcaggcttgggcaatt

SEQ ID NO: 2243 - DNA, 20 bp, synthetic construct
  source 1..20: mol_type = other DNA
tggaatatcatgttaaatgg

SEQ ID NO: 2244 - DNA, 20 bp, synthetic construct
  source 1..20: mol_type = other DNA
aaataaatactcaaggccat

SEQ ID NO: 2245 - DNA, 20 bp, synthetic construct
  source 1..20: mol_type = other DNA
tattttcacccaactccata

SEQ ID NO: 2246 - DNA, 20 bp, synthetic construct
  source 1..20: mol_type = other DNA
tttgcattctcatctagaat

SEQ ID NO: 2247 - DNA, 20 bp, synthetic construct
  source 1..20: mol_type = other DNA
cccctgagtcctggagaacc

SEQ ID NO: 2248 - DNA, 20 bp, synthetic construct
  source 1..20: mol_type = other DNA
attgggttttactctgccta

SEQ ID NO: 2249 - DNA, 20 bp, synthetic construct
  source 1..20: mol_type = other DNA
ccacatgcaaaaatatttct

SEQ ID NO: 2250 - DNA, 20 bp, synthetic construct
  source 1..20: mol_type = other DNA
acatctgtgtataaatatgt

SEQ ID NO: 2251 - DNA, 20 bp, synthetic construct
  source 1..20: mol_type = other DNA
gatgaatattcaatggcatt

SEQ ID NO: 2252 - DNA, 20 bp, synthetic construct
  source 1..20: mol_type = other DNA
aaaacacaaaggctcacgga

SEQ ID NO: 2253 - DNA, 20 bp, synthetic construct
  source 1..20: mol_type = other DNA
ctgtcagtgccctggccact

SEQ ID NO: 2254 - DNA, 20 bp, synthetic construct
  source 1..20: mol_type = other DNA
gtggctagcttctagccaag

SEQ ID NO: 2255 - DNA, 20 bp, synthetic construct
  source 1..20: mol_type = other DNA
tgttattatcattcctcttt

SEQ ID NO: 2256 - DNA, 20 bp, synthetic construct
  source 1..20: mol_type = other DNA
aaagccttttatatatgcat

SEQ ID NO: 2257 - DNA, 20 bp, synthetic construct
  source 1..20: mol_type = other DNA
ctttttaagtcctccatatt

SEQ ID NO: 2258 - DNA, 20 bp, synthetic construct
  source 1..20: mol_type = other DNA
agaaaacagcagccatagta

SEQ ID NO: 2259 - DNA, 20 bp, synthetic construct
  source 1..20: mol_type = other DNA
aagtgattttctccacatca

SEQ ID NO: 2260 - DNA, 20 bp, synthetic construct
  source 1..20: mol_type = other DNA
tgcatagtctgtaggtagta

SEQ ID NO: 2261 - DNA, 20 bp, synthetic construct
  source 1..20: mol_type = other DNA
tgttgtcacccttgtaaaat

SEQ ID NO: 2262 - DNA, 20 bp, synthetic construct
  source 1..20: mol_type = other DNA
aattcactgagggttagaat

SEQ ID NO: 2263 - DNA, 20 bp, synthetic construct
  source 1..20: mol_type = other DNA
agcacatccccagagtctgt

SEQ ID NO: 2264 - DNA, 20 bp, synthetic construct
  source 1..20: mol_type = other DNA
taaattgaaagaatagtaga

SEQ ID NO: 2265 - DNA, 20 bp, synthetic construct
  source 1..20: mol_type = other DNA
aaatgcccaccagtctccaa

SEQ ID NO: 2266 - DNA, 20 bp, synthetic construct
  source 1..20: mol_type = other DNA
aaaccttgatgtataaaggc

SEQ ID NO: 2267 - DNA, 20 bp, synthetic construct
  source 1..20: mol_type = other DNA
tacacaagccacgaaaggat

SEQ ID NO: 2268 - DNA, 20 bp, synthetic construct
  source 1..20: mol_type = other DNA
tcttcattgacacaccacac

SEQ ID NO: 2269 - DNA, 20 bp, synthetic construct
  source 1..20: mol_type = other DNA
tcactctggccttctgctta

SEQ ID NO: 2270 - DNA, 20 bp, synthetic construct
  source 1..20: mol_type = other DNA
atatccatataatttctcat

SEQ ID NO: 2271 - DNA, 20 bp, synthetic construct
  source 1..20: mol_type = other DNA
gaattaaatgattaaagtat

SEQ ID NO: 2272 - DNA, 20 bp, synthetic construct
  source 1..20: mol_type = other DNA
ttttgtaaattatttccaga

SEQ ID NO: 2273 - DNA, 20 bp, synthetic construct
  source 1..20: mol_type = other DNA
aaaaattattttactgagtc

SEQ ID NO: 2274 - DNA, 20 bp, synthetic construct
  source 1..20: mol_type = other DNA
tgagacaaacaaattatcaa

SEQ ID NO: 2275 - DNA, 20 bp, synthetic construct
  source 1..20: mol_type = other DNA
cgctgttgaagaaacctagt

SEQ ID NO: 2276 - DNA, 20 bp, synthetic construct
  source 1..20: mol_type = other DNA
gagcctggagggaaagacac

SEQ ID NO: 2277 - DNA, 20 bp, synthetic construct
  source 1..20: mol_type = other DNA
gatcaaaggcaaatatgaaa

SEQ ID NO: 2278 - DNA, 20 bp, synthetic construct
  source 1..20: mol_type = other DNA
atttctagcaaggtaatatg

SEQ ID NO: 2279 - DNA, 20 bp, synthetic construct
  source 1..20: mol_type = other DNA
gtacaggatgcagctaccta

SEQ ID NO: 2280 - DNA, 20 bp, synthetic construct
  source 1..20: mol_type = other DNA
gttactagaatgtagcagaa

SEQ ID NO: 2281 - DNA, 20 bp, synthetic construct
  source 1..20: mol_type = other DNA
catctccctaatttctctaa

SEQ ID NO: 2282 - DNA, 20 bp, synthetic construct
  source 1..20: mol_type = other DNA
gtcattttataaaatatggc

SEQ ID NO: 2283 - DNA, 20 bp, synthetic construct
  source 1..20: mol_type = other DNA
aactgttacatactggaatc

SEQ ID NO: 2284 - DNA, 20 bp, synthetic construct
  source 1..20: mol_type = other DNA
atgtgcaatttaatataatt

SEQ ID NO: 2285 - DNA, 20 bp, synthetic construct
  source 1..20: mol_type = other DNA
acttgtggcccacaggtcgc

SEQ ID NO: 2286 - DNA, 20 bp, synthetic construct
  source 1..20: mol_type = other DNA
tgttgaaatgtatagcttgt

SEQ ID NO: 2287 - DNA, 20 bp, synthetic construct
  source 1..20: mol_type = other DNA
gacatgtgagatggtcatgc

SEQ ID NO: 2288 - DNA, 20 bp, synthetic construct
  source 1..20: mol_type = other DNA
tcttcatagcttaaagtaaa

SEQ ID NO: 2289 - DNA, 20 bp, synthetic construct
  source 1..20: mol_type = other DNA
gaatctacaaatctaacttt

SEQ ID NO: 2290 - DNA, 20 bp, synthetic construct
  source 1..20: mol_type = other DNA
aaaattggaggcagagttta

SEQ ID NO: 2291 - DNA, 20 bp, synthetic construct
  source 1..20: mol_type = other DNA
atattgttacagatacaatg

SEQ ID NO: 2292 - DNA, 20 bp, synthetic construct
  source 1..20: mol_type = other DNA
ctccataatcctatatttat

SEQ ID NO: 2293 - DNA, 20 bp, synthetic construct
  source 1..20: mol_type = other DNA
aagtatgtctaagcttttta

SEQ ID NO: 2294 - DNA, 20 bp, synthetic construct
  source 1..20: mol_type = other DNA
ttgaaatttttctttgacca

SEQ ID NO: 2295 - DNA, 20 bp, synthetic construct
  source 1..20: mol_type = other DNA
tttccatcttaaatgattag

SEQ ID NO: 2296 - DNA, 20 bp, synthetic construct
  source 1..20: mol_type = other DNA
aatagaagaaggcactacag

SEQ ID NO: 2297 - DNA, 20 bp, synthetic construct
  source 1..20: mol_type = other DNA
aaataaaaatataaagtggc

SEQ ID NO: 2298 - DNA, 20 bp, synthetic construct
  source 1..20: mol_type = other DNA
tgaggcaaaatatagcatag

SEQ ID NO: 2299 - DNA, 20 bp, synthetic construct
  source 1..20: mol_type = other DNA
ctgctgcacactcgcgactc

SEQ ID NO: 2300 - DNA, 20 bp, synthetic construct
  source 1..20: mol_type = other DNA
tccacattattgcaaggaat

SEQ ID NO: 2301 - DNA, 20 bp, synthetic construct
  source 1..20: mol_type = other DNA
cctatggagcaaacagcaac

SEQ ID NO: 2302 - DNA, 20 bp, synthetic construct
  source 1..20: mol_type = other DNA
cttctgcattaactccaaaa

SEQ ID NO: 2303 - DNA, 20 bp, synthetic construct
  source 1..20: mol_type = other DNA
ttacagccactttcagccac

SEQ ID NO: 2304 - DNA, 20 bp, synthetic construct
  source 1..20: mol_type = other DNA
ttagtctgtatttcagcaac

SEQ ID NO: 2305 - DNA, 20 bp, synthetic construct
  source 1..20: mol_type = other DNA
ttcttgctagtgtagatgct

SEQ ID NO: 2306 - DNA, 20 bp, synthetic construct
  source 1..20: mol_type = other DNA
tgtcaaactcttcagagttt

SEQ ID NO: 2307 - DNA, 20 bp, synthetic construct
  source 1..20: mol_type = other DNA
aagaccgcaagtgtggaaga

SEQ ID NO: 2308 - DNA, 20 bp, synthetic construct
  source 1..20: mol_type = other DNA
ctgacatccagagatgtcag

SEQ ID NO: 2309 - DNA, 20 bp, synthetic construct
  source 1..20: mol_type = other DNA
aagaagcgcgagcctttata

SEQ ID NO: 2310 - DNA, 20 bp, synthetic construct
  source 1..20: mol_type = other DNA
aactgcagtgctgggtcttg

SEQ ID NO: 2311 - DNA, 20 bp, synthetic construct
  source 1..20: mol_type = other DNA
gcatttcatatagtcggatg

SEQ ID NO: 2312 - DNA, 20 bp, synthetic construct
  source 1..20: mol_type = other DNA
ttcctctgctttcttcatca

SEQ ID NO: 2313 - DNA, 20 bp, synthetic construct
  source 1..20: mol_type = other DNA
atcctgtgctgtagggttct

SEQ ID NO: 2314 - DNA, 20 bp, synthetic construct
  source 1..20: mol_type = other DNA
tcagcaacttcctcagaagt

SEQ ID NO: 2315 - DNA, 20 bp, synthetic construct
  source 1..20: mol_type = other DNA
tggcctcctccagttcctat

SEQ ID NO: 2316 - DNA, 20 bp, synthetic construct
  source 1..20: mol_type = other DNA
ctattatgtctaggaaagac

SEQ ID NO: 2317 - DNA, 20 bp, synthetic construct
  source 1..20: mol_type = other DNA
ctccttaagagtccgggttt

SEQ ID NO: 2318 - DNA, 20 bp, synthetic construct
  source 1..20: mol_type = other DNA
tgacactcataactactccg

SEQ ID NO: 2319 - DNA, 20 bp, synthetic construct
  source 1..20: mol_type = other DNA
aatacaattaaattggtagt

SEQ ID NO: 2320 - DNA, 20 bp, synthetic construct
  source 1..20: mol_type = other DNA
aaaatctacaacttaaccag

SEQ ID NO: 2321 - DNA, 20 bp, synthetic construct
  source 1..20: mol_type = other DNA
aaaaagttaaaagcactact

SEQ ID NO: 2322 - DNA, 20 bp, synthetic construct
  source 1..20: mol_type = other DNA
ctttaagaatatctcctaca

SEQ ID NO: 2323 - DNA, 20 bp, synthetic construct
  source 1..20: mol_type = other DNA
agtgatcaacattcattttt

SEQ ID NO: 2324 - DNA, 20 bp, synthetic construct
  source 1..20: mol_type = other DNA
ttattgttcagccccaccca

SEQ ID NO: 2325 - DNA, 20 bp, synthetic construct
  source 1..20: mol_type = other DNA
ctatcctgtgaacaatattg

SEQ ID NO: 2326 - DNA, 20 bp, synthetic construct
  source 1..20: mol_type = other DNA
tatatttatatacatctgtg

SEQ ID NO: 2327 - DNA, 20 bp, synthetic construct
  source 1..20: mol_type = other DNA
agttaagtgaaacattagct

SEQ ID NO: 2328 - DNA, 20 bp, synthetic construct
  source 1..20: mol_type = other DNA
aacaaatagacggtcaagat

SEQ ID NO: 2329 - DNA, 20 bp, synthetic construct
  source 1..20: mol_type = other DNA
tccctgtccagacctcttta

SEQ ID NO: 2330 - DNA, 20 bp, synthetic construct
  source 1..20: mol_type = other DNA
atactgccagagcctgaaaa

SEQ ID NO: 2331 - DNA, 20 bp, synthetic construct
  source 1..20: mol_type = other DNA
ttagttagactgatgttaaa

SEQ ID NO: 2332 - DNA, 20 bp, synthetic construct
  source 1..20: mol_type = other DNA
gaagaaattatttgtgcctc

SEQ ID NO: 2333 - DNA, 20 bp, synthetic construct
  source 1..20: mol_type = other DNA
gaggtcctactattcaaatg

SEQ ID NO: 2334 - DNA, 20 bp, synthetic construct
  source 1..20: mol_type = other DNA
cttctctttttcatactcag

SEQ ID NO: 2335 - DNA, 20 bp, synthetic construct
  source 1..20: mol_type = other DNA
agaagactggttttacttta

SEQ ID NO: 2336 - DNA, 20 bp, synthetic construct
  source 1..20: mol_type = other DNA
ggtgcatagtctgtaggtag

SEQ ID NO: 2337 - DNA, 20 bp, synthetic construct
  source 1..20: mol_type = other DNA
ttcacaggtgtgtatttcac

SEQ ID NO: 2338 - DNA, 20 bp, synthetic construct
  source 1..20: mol_type = other DNA
aaatcagtatccttgatttt

SEQ ID NO: 2339 - DNA, 20 bp, synthetic construct
  source 1..20: mol_type = other DNA
ggaaaaagaactaataccct

SEQ ID NO: 2340 - DNA, 20 bp, synthetic construct
  source 1..20: mol_type = other DNA
aaaatcctgttgggtagaaa

SEQ ID NO: 2341 - DNA, 20 bp, synthetic construct
  source 1..20: mol_type = other DNA
cccttacagctagcaagcaa

SEQ ID NO: 2342 - DNA, 20 bp, synthetic construct
  source 1..20: mol_type = other DNA
aacttttggagcctactgag

SEQ ID NO: 2343 - DNA, 20 bp, synthetic construct
  source 1..20: mol_type = other DNA
tcattatatatttcaccata

SEQ ID NO: 2344 - DNA, 20 bp, synthetic construct
  source 1..20: mol_type = other DNA
taagaataaggtataaatca

SEQ ID NO: 2345 - DNA, 20 bp, synthetic construct
  source 1..20: mol_type = other DNA
attttaaattcccctactct

SEQ ID NO: 2346 - DNA, 20 bp, synthetic construct
  source 1..20: mol_type = other DNA
tgagtgaaaaagctatatcc

SEQ ID NO: 2347 - DNA, 20 bp, synthetic construct
  source 1..20: mol_type = other DNA
agagctatcctatcaacaaa

SEQ ID NO: 2348 - DNA, 20 bp, synthetic construct
  source 1..20: mol_type = other DNA
cttacacacctctggtaact

SEQ ID NO: 2349 - DNA, 20 bp, synthetic construct
  source 1..20: mol_type = other DNA
tttgtctgtgctctgaactt

SEQ ID NO: 2350 - DNA, 20 bp, synthetic construct
  source 1..20: mol_type = other DNA
cctaattggagtaatttctt

SEQ ID NO: 2351 - DNA, 20 bp, synthetic construct
  source 1..20: mol_type = other DNA
tccatacagtctaccaggtt

SEQ ID NO: 2352 - DNA, 20 bp, synthetic construct
  source 1..20: mol_type = other DNA
ggcatcaaaaacattttctc

SEQ ID NO: 2353 - DNA, 20 bp, synthetic construct
  source 1..20: mol_type = other DNA
agatgcctgctctgctaatg

SEQ ID NO: 2354 - DNA, 20 bp, synthetic construct
  source 1..20: mol_type = other DNA
ttcacacataagtagaaatt

SEQ ID NO: 2355 - DNA, 20 bp, synthetic construct
  source 1..20: mol_type = other DNA
ctgtataagatatacccatc

SEQ ID NO: 2356 - DNA, 20 bp, synthetic construct
  source 1..20: mol_type = other DNA
tgctattcatatagagtctc

SEQ ID NO: 2357 - DNA, 20 bp, synthetic construct
  source 1..20: mol_type = other DNA
attttggaaaccagtaacac

SEQ ID NO: 2358 - DNA, 20 bp, synthetic construct
  source 1..20: mol_type = other DNA
tttgagtatgtcaccatgta

SEQ ID NO: 2359 - DNA, 20 bp, synthetic construct
  source 1..20: mol_type = other DNA
attagttaggattgttggta

SEQ ID NO: 2360 - DNA, 20 bp, synthetic construct
  source 1..20: mol_type = other DNA
aggattctcagatacagtgt

SEQ ID NO: 2361 - DNA, 20 bp, synthetic construct
  source 1..20: mol_type = other DNA
aatcctatggtgagtacctc

SEQ ID NO: 2362 - DNA, 20 bp, synthetic construct
  source 1..20: mol_type = other DNA
gatccaatggcaacaaccct

SEQ ID NO: 2363 - DNA, 20 bp, synthetic construct
  source 1..20: mol_type = other DNA
ggaatgtaaggtgactctca

SEQ ID NO: 2364 - DNA, 20 bp, synthetic construct
  source 1..20: mol_type = other DNA
agactagcaaaatagctttt

SEQ ID NO: 2365 - DNA, 20 bp, synthetic construct
  source 1..20: mol_type = other DNA
gtggacctgaatttgatttg

SEQ ID NO: 2366 - DNA, 20 bp, synthetic construct
  source 1..20: mol_type = other DNA
aggaagattcattaaacgga

SEQ ID NO: 2367 - DNA, 20 bp, synthetic construct
  source 1..20: mol_type = other DNA
aaagatggagctcagcagtc

SEQ ID NO: 2368 - DNA, 20 bp, synthetic construct
  source 1..20: mol_type = other DNA
tttgccttataactattttt

SEQ ID NO: 2369 - DNA, 20 bp, synthetic construct
  source 1..20: mol_type = other DNA
attctgtttttgatctggag

SEQ ID NO: 2370 - DNA, 20 bp, synthetic construct
  source 1..20: mol_type = other DNA
ccttgcccaattccatccat

SEQ ID NO: 2371 - DNA, 20 bp, synthetic construct
  source 1..20: mol_type = other DNA
tattcttgtttgaaactggt

SEQ ID NO: 2372 - DNA, 20 bp, synthetic construct
  source 1..20: mol_type = other DNA
ccctcacactagattatgag

SEQ ID NO: 2373 - DNA, 20 bp, synthetic construct
  source 1..20: mol_type = other DNA
agaaaaactgtcagatgaat

SEQ ID NO: 2374 - DNA, 20 bp, synthetic construct
  source 1..20: mol_type = other DNA
atattctagtgaagagacta

SEQ ID NO: 2375 - DNA, 20 bp, synthetic construct
  source 1..20: mol_type = other DNA
ctttgcattgtacctggaca

SEQ ID NO: 2376 - DNA, 20 bp, synthetic construct
  source 1..20: mol_type = other DNA
gacttccacattattgcaag

SEQ ID NO: 2377 - DNA, 20 bp, synthetic construct
  source 1..20: mol_type = other DNA
atagtctcagtgaggagggc

SEQ ID NO: 2378 - DNA, 20 bp, synthetic construct
  source 1..20: mol_type = other DNA
gagaatgtatatgcttctgc

SEQ ID NO: 2379 - DNA, 20 bp, synthetic construct
  source 1..20: mol_type = other DNA
tatatccagggaagtgttgc

SEQ ID NO: 2380 - DNA, 20 bp, synthetic construct
  source 1..20: mol_type = other DNA
agaaaaagatgctgacaatt

SEQ ID NO: 2381 - DNA, 20 bp, synthetic construct
  source 1..20: mol_type = other DNA
gccttcacttccttcactat

SEQ ID NO: 2382 - DNA, 20 bp, synthetic construct
  source 1..20: mol_type = other DNA
ccaaatgtgtcaaactcttc

SEQ ID NO: 2383 - DNA, 20 bp, synthetic construct
  source 1..20: mol_type = other DNA
ttatggctaaataagagttc

SEQ ID NO: 2384 - DNA, 20 bp, synthetic construct
  source 1..20: mol_type = other DNA
gatgcagttcatccaaagga

SEQ ID NO: 2385 - DNA, 20 bp, synthetic construct
  source 1..20: mol_type = other DNA
ttttccgaagttttgccaaa

SEQ ID NO: 2386 - DNA, 20 bp, synthetic construct
  source 1..20: mol_type = other DNA
gggtgttttggacaaccttc

SEQ ID NO: 2387 - DNA, 20 bp, synthetic construct
  source 1..20: mol_type = other DNA
taaggcatttcatatagtcg

SEQ ID NO: 2388 - DNA, 20 bp, synthetic construct
  source 1..20: mol_type = other DNA
tgagccttggttgatctgga

SEQ ID NO: 2389 - DNA, 20 bp, synthetic construct
  source 1..20: mol_type = other DNA
aatcatggctgagtggaggt

SEQ ID NO: 2390 - DNA, 20 bp, synthetic construct
  source 1..20: mol_type = other DNA
ttccttttcaacaggaagat

SEQ ID NO: 2391 - DNA, 20 bp, synthetic construct
  source 1..20: mol_type = other DNA
ttcctagctgtgctgtcatc

SEQ ID NO: 2392 - DNA, 20 bp, synthetic construct
  source 1..20: mol_type = other DNA
gaagcagattagaaaacaag

SEQ ID NO: 2393 - DNA, 20 bp, synthetic construct
  source 1..20: mol_type = other DNA
ctttacctgctgcacactcg

SEQ ID NO: 2394 - DNA, 20 bp, synthetic construct
  source 1..20: mol_type = other DNA
ccagagactggaaatgaaag

SEQ ID NO: 2395 - DNA, 20 bp, synthetic construct
  source 1..20: mol_type = other DNA
tccattaatctattcaatta

SEQ ID NO: 2396 - DNA, 20 bp, synthetic construct
  source 1..20: mol_type = other DNA
gtatcgattctattattaaa

SEQ ID NO: 2397 - DNA, 20 bp, synthetic construct
  source 1..20: mol_type = other DNA
aatcaagctaccctaatcct

SEQ ID NO: 2398 - DNA, 20 bp, synthetic construct
  source 1..20: mol_type = other DNA
taaatgagataaactcccag

SEQ ID NO: 2399 - DNA, 20 bp, synthetic construct
  source 1..20: mol_type = other DNA
tattgggcaacaacctgaaa

SEQ ID NO: 2400 - DNA, 20 bp, synthetic construct
  source 1..20: mol_type = other DNA
ttttagctgctactttcttg

SEQ ID NO: 2401 - DNA, 20 bp, synthetic construct
  source 1..20: mol_type = other DNA
gatacataaaaaagagtaaa

SEQ ID NO: 2402 - DNA, 20 bp, synthetic construct
  source 1..20: mol_type = other DNA
agattaaaacattatcagat

SEQ ID NO: 2403 - DNA, 20 bp, synthetic construct
  source 1..20: mol_type = other DNA
acaactgttagtttccttga

SEQ ID NO: 2404 - DNA, 20 bp, synthetic construct
  source 1..20: mol_type = other DNA
tttcaaaagcatatgcagca

SEQ ID NO: 2405 - DNA, 20 bp, synthetic construct
  source 1..20: mol_type = other DNA
cagtcgaaatttcacaaagt

SEQ ID NO: 2406 - DNA, 20 bp, synthetic construct
  source 1..20: mol_type = other DNA
cttaagtactgcttttaaaa

SEQ ID NO: 2407 - DNA, 20 bp, synthetic construct
  source 1..20: mol_type = other DNA
cctcccctccttgggtaacc

SEQ ID NO: 2408 - DNA, 20 bp, synthetic construct
  source 1..20: mol_type = other DNA
tcagcctttccttccacact

SEQ ID NO: 2409 - DNA, 20 bp, synthetic construct
  source 1..20: mol_type = other DNA
tattacaccttaagaagatg

SEQ ID NO: 2410 - DNA, 20 bp, synthetic construct
  source 1..20: mol_type = other DNA
ttacacaatttaaatgtaat

SEQ ID NO: 2411 - DNA, 20 bp, synthetic construct
  source 1..20: mol_type = other DNA
ttagttccagaaaatactat

SEQ ID NO: 2412 - DNA, 20 bp, synthetic construct
  source 1..20: mol_type = other DNA
ccagggtgcatagtctgtag

SEQ ID NO: 2413 - DNA, 20 bp, synthetic construct
  source 1..20: mol_type = other DNA
cttctacaaaaaaaagtcag

SEQ ID NO: 2414 - DNA, 20 bp, synthetic construct
  source 1..20: mol_type = other DNA
cactgaatttctaggaaaat

SEQ ID NO: 2415 - DNA, 20 bp, synthetic construct
  source 1..20: mol_type = other DNA
agaatactgagcaaagacaa

SEQ ID NO: 2416 - DNA, 20 bp, synthetic construct
  source 1..20: mol_type = other DNA
gtctaacacaactccaccct

SEQ ID NO: 2417 - DNA, 20 bp, synthetic construct
  source 1..20: mol_type = other DNA
ccaagataacaggtaataga

SEQ ID NO: 2418 - DNA, 20 bp, synthetic construct
  source 1..20: mol_type = other DNA
cttccagactggtgatagca

SEQ ID NO: 2419 - DNA, 20 bp, synthetic construct
  source 1..20: mol_type = other DNA
agacacaatattttggaaca

SEQ ID NO: 2420 - DNA, 20 bp, synthetic construct
  source 1..20: mol_type = other DNA
gttagaaattttaaaagact

SEQ ID NO: 2421 - DNA, 20 bp, synthetic construct
  source 1..20: mol_type = other DNA
ctggaatagggtctagcagc

SEQ ID NO: 2422 - DNA, 20 bp, synthetic construct
  source 1..20: mol_type = other DNA
aaaaatgggcccctattaaa

SEQ ID NO: 2423 - DNA, 20 bp, synthetic construct
  source 1..20: mol_type = other DNA
tcccttaaatatacttaaaa

SEQ ID NO: 2424 - DNA, 20 bp, synthetic construct
  source 1..20: mol_type = other DNA
gttgttaaaactcattgcta

SEQ ID NO: 2425 - DNA, 20 bp, synthetic construct
  source 1..20: mol_type = other DNA
gaccacttctcaaactatta

SEQ ID NO: 2426 - DNA, 20 bp, synthetic construct
  source 1..20: mol_type = other DNA
ctcccaaacaatctatgtca

SEQ ID NO: 2427 - DNA, 20 bp, synthetic construct
  source 1..20: mol_type = other DNA
aaccgatcaaagtacctagc

SEQ ID NO: 2428 - DNA, 20 bp, synthetic construct
  source 1..20: mol_type = other DNA
cacagtgacaaaattcatga

SEQ ID NO: 2429 - DNA, 20 bp, synthetic construct
  source 1..20: mol_type = other DNA
tatctcttaacccagagaat

SEQ ID NO: 2430 - DNA, 20 bp, synthetic construct
  source 1..20: mol_type = other DNA
ctgggactagaagctgtgca

SEQ ID NO: 2431 - DNA, 20 bp, synthetic construct
  source 1..20: mol_type = other DNA
acttaattactccacagaat

SEQ ID NO: 2432 - DNA, 20 bp, synthetic construct
  source 1..20: mol_type = other DNA
ttctctcatttgaatatcag

SEQ ID NO: 2433 - DNA, 20 bp, synthetic construct
  source 1..20: mol_type = other DNA
taaaaagagttaaatcccct

SEQ ID NO: 2434 - DNA, 20 bp, synthetic construct
  source 1..20: mol_type = other DNA
tgtacaaagtatatcttttt

SEQ ID NO: 2435 - DNA, 20 bp, synthetic construct
  source 1..20: mol_type = other DNA
attagattgtaaatatgtta

SEQ ID NO: 2436 - DNA, 20 bp, synthetic construct
  source 1..20: mol_type = other DNA
ccaagtttctacatttctaa

SEQ ID NO: 2437 - DNA, 20 bp, synthetic construct
  source 1..20: mol_type = other DNA
ttgttgagaaaagcacagat

SEQ ID NO: 2438 - DNA, 20 bp, synthetic construct
  source 1..20: mol_type = other DNA
cattggcattcattcaatcc

SEQ ID NO: 2439 - DNA, 20 bp, synthetic construct
  source 1..20: mol_type = other DNA
ggtatctgcaaggaacctca

SEQ ID NO: 2440 - DNA, 20 bp, synthetic construct
  source 1..20: mol_type = other DNA
ttcaattgtatgagggcctg

SEQ ID NO: 2441 - DNA, 20 bp, synthetic construct
  source 1..20: mol_type = other DNA
ttacttcctgctcaaactga

SEQ ID NO: 2442 - DNA, 20 bp, synthetic construct
  source 1..20: mol_type = other DNA
caggagctctgctctcaggc

SEQ ID NO: 2443 - DNA, 20 bp, synthetic construct
  source 1..20: mol_type = other DNA
gtactactctttctttcttt

SEQ ID NO: 2444 - DNA, 20 bp, synthetic construct
  source 1..20: mol_type = other DNA
ttttttctgatttgatttgt

SEQ ID NO: 2445 - DNA, 20 bp, synthetic construct
  source 1..20: mol_type = other DNA
gcatgcaattctatattgca

SEQ ID NO: 2446 - DNA, 20 bp, synthetic construct
  source 1..20: mol_type = other DNA
cccacttccttccaacaagg

SEQ ID NO: 2447 - DNA, 20 bp, synthetic construct
  source 1..20: mol_type = other DNA
gaaaggttattgcccaagtt

SEQ ID NO: 2448 - DNA, 20 bp, synthetic construct
  source 1..20: mol_type = other DNA
gccacatcagcatggcaaac

SEQ ID NO: 2449 - DNA, 20 bp, synthetic construct
  source 1..20: mol_type = other DNA
taccaaagctatctaattca

SEQ ID NO: 2450 - DNA, 20 bp, synthetic construct
  source 1..20: mol_type = other DNA
ttaaacgaggtaatgtgtgt

SEQ ID NO: 2451 - DNA, 20 bp, synthetic construct
  source 1..20: mol_type = other DNA
ttaagctttgcattgtacct

SEQ ID NO: 2452 - DNA, 20 bp, synthetic construct
  source 1..20: mol_type = other DNA
aggacttccacattattgca

SEQ ID NO: 2453 - DNA, 20 bp, synthetic construct
  source 1..20: mol_type = other DNA
cttgatttaagaaaatagtc

SEQ ID NO: 2454 - DNA, 20 bp, synthetic construct
  source 1..20: mol_type = other DNA
ggagaatgtatatgcttctg

SEQ ID NO: 2455 - DNA, 20 bp, synthetic construct
  source 1..20: mol_type = other DNA
ggaccactgctgccattata

SEQ ID NO: 2456 - DNA, 20 bp, synthetic construct
  source 1..20: mol_type = other DNA
gaatattactaagtcaaatg

SEQ ID NO: 2457 - DNA, 20 bp, synthetic construct
  source 1..20: mol_type = other DNA
cctacactaattgaattaga

SEQ ID NO: 2458 - DNA, 20 bp, synthetic construct
  source 1..20: mol_type = other DNA
tccaaatgtgtcaaactctt

SEQ ID NO: 2459 - DNA, 20 bp, synthetic construct
  source 1..20: mol_type = other DNA
tctgattatggctaaataag

SEQ ID NO: 2460 - DNA, 20 bp, synthetic construct
  source 1..20: mol_type = other DNA
gttaagatgcagttcatcca

SEQ ID NO: 2461 - DNA, 20 bp, synthetic construct
  source 1..20: mol_type = other DNA
cgtttatgatggttttccga

SEQ ID NO: 2462 - DNA, 20 bp, synthetic construct
  source 1..20: mol_type = other DNA
gacatgtagttctttggaaa

SEQ ID NO: 2463 - DNA, 20 bp, synthetic construct
  source 1..20: mol_type = other DNA
ataaggcatttcatatagtc

SEQ ID NO: 2464 - DNA, 20 bp, synthetic construct
  source 1..20: mol_type = other DNA
gtgagccttggttgatctgg

SEQ ID NO: 2465 - DNA, 20 bp, synthetic construct
  source 1..20: mol_type = other DNA
gggtttcaggtctcggtata

SEQ ID NO: 2466 - DNA, 20 bp, synthetic construct
  source 1..20: mol_type = other DNA
caggagagtaccagactgtg

SEQ ID NO: 2467 - DNA, 20 bp, synthetic construct
  source 1..20: mol_type = other DNA
ccagcatgacatttttaagg

SEQ ID NO: 2468 - DNA, 20 bp, synthetic construct
  source 1..20: mol_type = other DNA
aagcattagaatgaagcaga

SEQ ID NO: 2469 - DNA, 20 bp, synthetic construct
  source 1..20: mol_type = other DNA
gcctttacctgctgcacact

SEQ ID NO: 2470 - DNA, 20 bp, synthetic construct
  source 1..20: mol_type = other DNA
ctctaaattaattacttaac

SEQ ID NO: 2471 - DNA, 20 bp, synthetic construct
  source 1..20: mol_type = other DNA
tgattaaatagaatctctgg

SEQ ID NO: 2472 - DNA, 20 bp, synthetic construct
  source 1..20: mol_type = other DNA
aaatgtactatttaaagaca

SEQ ID NO: 2473 - DNA, 20 bp, synthetic construct
  source 1..20: mol_type = other DNA
ggctgtcccatcactaggtc

SEQ ID NO: 2474 - DNA, 20 bp, synthetic construct
  source 1..20: mol_type = other DNA
gttagacttatcaagctcta

SEQ ID NO: 2475 - DNA, 20 bp, synthetic construct
  source 1..20: mol_type = other DNA
tttgatcaagccagtaagtt

SEQ ID NO: 2476 - DNA, 20 bp, synthetic construct
  source 1..20: mol_type = other DNA
tgtttaaaaaaaggctgttt

SEQ ID NO: 2477 - DNA, 20 bp, synthetic construct
  source 1..20: mol_type = other DNA
attatcttagggaaaggaca

SEQ ID NO: 2478 - DNA, 20 bp, synthetic construct
  source 1..20: mol_type = other DNA
tgtgctactctgacacctgg

SEQ ID NO: 2479 - DNA, 20 bp, synthetic construct
  source 1..20: mol_type = other DNA
gtatatttgtcacaactgtt

SEQ ID NO: 2480 - DNA, 20 bp, synthetic construct
  source 1..20: mol_type = other DNA
gctttttcaaaagcatatgc

SEQ ID NO: 2481 - DNA, 20 bp, synthetic construct
  source 1..20: mol_type = other DNA
tgtaaccagtcctcagacac

SEQ ID NO: 2482 - DNA, 20 bp, synthetic construct
  source 1..20: mol_type = other DNA
acataaaaagttttaactta

SEQ ID NO: 2483 - DNA, 20 bp, synthetic construct
  source 1..20: mol_type = other DNA
aaagtcccagtttaaacaca

SEQ ID NO: 2484 - DNA, 20 bp, synthetic construct
  source 1..20: mol_type = other DNA
ttttctttgggcctcagcct

SEQ ID NO: 2485 - DNA, 20 bp, synthetic construct
  source 1..20: mol_type = other DNA
gaggctgcctattacacctt

SEQ ID NO: 2486 - DNA, 20 bp, synthetic construct
  source 1..20: mol_type = other DNA
ttttgcattacacaatttaa

SEQ ID NO: 2487 - DNA, 20 bp, synthetic construct
  source 1..20: mol_type = other DNA
tggagttaggccatatgaat

SEQ ID NO: 2488 - DNA, 20 bp, synthetic construct
  source 1..20: mol_type = other DNA
gtccagggtgcatagtctgt

SEQ ID NO: 2489 - DNA, 20 bp, synthetic construct
  source 1..20: mol_type = other DNA
taccagtatcttaaattcag

SEQ ID NO: 2490 - DNA, 20 bp, synthetic construct
  source 1..20: mol_type = other DNA
agttcccaaattctttccaa

SEQ ID NO: 2491 - DNA, 20 bp, synthetic construct
  source 1..20: mol_type = other DNA
aatggcagggctcttacatt

SEQ ID NO: 2492 - DNA, 20 bp, synthetic construct
  source 1..20: mol_type = other DNA
gagccaccctgcatgaagct

SEQ ID NO: 2493 - DNA, 20 bp, synthetic construct
  source 1..20: mol_type = other DNA
gcactgcatgctggccctac

SEQ ID NO: 2494 - DNA, 20 bp, synthetic construct
  source 1..20: mol_type = other DNA
ttatataatgtggtgaatgg

SEQ ID NO: 2495 - DNA, 20 bp, synthetic construct
  source 1..20: mol_type = other DNA
tgacttgagacacaatattt

SEQ ID NO: 2496 - DNA, 20 bp, synthetic construct
  source 1..20: mol_type = other DNA
attgtgaacaaagaaaatcc

SEQ ID NO: 2497 - DNA, 20 bp, synthetic construct
  source 1..20: mol_type = other DNA
caaatcaatcaacggttaca

SEQ ID NO: 2498 - DNA, 20 bp, synthetic construct
  source 1..20: mol_type = other DNA
taattggaggaaattcaacc

SEQ ID NO: 2499 - DNA, 20 bp, synthetic construct
  source 1..20: mol_type = other DNA
gaaaaaacatcccttaaata

SEQ ID NO: 2500 - DNA, 20 bp, synthetic construct
  source 1..20: mol_type = other DNA
taaaagttgtaatattcatt

SEQ ID NO: 2501 - DNA, 20 bp, synthetic construct
  source 1..20: mol_type = other DNA
ttcagagtcttgagtttcat

SEQ ID NO: 2502 - DNA, 20 bp, synthetic construct
  source 1..20: mol_type = other DNA
tctttagattgtgtaattgg

SEQ ID NO: 2503 - DNA, 20 bp, synthetic construct
  source 1..20: mol_type = other DNA
cacttttagcatatttgtca

SEQ ID NO: 2504 - DNA, 20 bp, synthetic construct
  source 1..20: mol_type = other DNA
aaatggaacagaactaagct

SEQ ID NO: 2505 - DNA, 20 bp, synthetic construct
  source 1..20: mol_type = other DNA
caaatggttactcaagagac

SEQ ID NO: 2506 - DNA, 20 bp, synthetic construct
  source 1..20: mol_type = other DNA
atttcagcatagctagtgac

SEQ ID NO: 2507 - DNA, 20 bp, synthetic construct
  source 1..20: mol_type = other DNA
ctttcatggagtttcaactt

SEQ ID NO: 2508 - DNA, 20 bp, synthetic construct
  source 1..20: mol_type = other DNA
tcccatgttgtgtactttat

SEQ ID NO: 2509 - DNA, 20 bp, synthetic construct
  source 1..20: mol_type = other DNA
tgcacacaacacaagtgatt

SEQ ID NO: 2510 - DNA, 20 bp, synthetic construct
  source 1..20: mol_type = other DNA
tctccattccacaacatata

SEQ ID NO: 2511 - DNA, 20 bp, synthetic construct
  source 1..20: mol_type = other DNA
atggaaagcctctacctatt

SEQ ID NO: 2512 - DNA, 20 bp, synthetic construct
  source 1..20: mol_type = other DNA
tggaggcagctaggagtctg

SEQ ID NO: 2513 - DNA, 20 bp, synthetic construct
  source 1..20: mol_type = other DNA
caaaggcctaaagccaatta

SEQ ID NO: 2514 - DNA, 20 bp, synthetic construct
  source 1..20: mol_type = other DNA
aggccttccagaccttctcg

SEQ ID NO: 2515 - DNA, 20 bp, synthetic construct
  source 1..20: mol_type = other DNA
gatataaagcctctggtatc

SEQ ID NO: 2516 - DNA, 20 bp, synthetic construct
  source 1..20: mol_type = other DNA
cctgaactttcaattgtatg

SEQ ID NO: 2517 - DNA, 20 bp, synthetic construct
  source 1..20: mol_type = other DNA
ctaaatgatttacttcctgc

SEQ ID NO: 2518 - DNA, 20 bp, synthetic construct
  source 1..20: mol_type = other DNA
tgccataggacccagaatta

SEQ ID NO: 2519 - DNA, 20 bp, synthetic construct
  source 1..20: mol_type = other DNA
cagaaagttatcaaatatgt

SEQ ID NO: 2520 - DNA, 20 bp, synthetic construct
  source 1..20: mol_type = other DNA
agctcgaaaaagaaattgca

SEQ ID NO: 2521 - DNA, 20 bp, synthetic construct
  source 1..20: mol_type = other DNA
taacttgaaaagaaaatctc

SEQ ID NO: 2522 - DNA, 20 bp, synthetic construct
  source 1..20: mol_type = other DNA
cctaatcacattgacaactg

SEQ ID NO: 2523 - DNA, 20 bp, synthetic construct
  source 1..20: mol_type = other DNA
gagatgactgaagatgtgaa

SEQ ID NO: 2524 - DNA, 20 bp, synthetic construct
  source 1..20: mol_type = other DNA
tttccctttcaacctaagac

SEQ ID NO: 2525 - DNA, 20 bp, synthetic construct
  source 1..20: mol_type = other DNA
ctttacttgaagcataaatt

SEQ ID NO: 2526 - DNA, 20 bp, synthetic construct
  source 1..20: mol_type = other DNA
cccaaagttacaatgttaaa

SEQ ID NO: 2527 - DNA, 20 bp, synthetic construct
  source 1..20: mol_type = other DNA
actggcattatgaactgtta

SEQ ID NO: 2528 - DNA, 20 bp, synthetic construct
  source 1..20: mol_type = other DNA
tgaggacttccacattattg

SEQ ID NO: 2529 - DNA, 20 bp, synthetic construct
  source 1..20: mol_type = other DNA
cttccagccaaaacaattta

SEQ ID NO: 2530 - DNA, 20 bp, synthetic construct
  source 1..20: mol_type = other DNA
tcaggagaatgtatatgctt

SEQ ID NO: 2531 - DNA, 20 bp, synthetic construct
  source 1..20: mol_type = other DNA
gcctccagctgcactggtaa

SEQ ID NO: 2532 - DNA, 20 bp, synthetic construct
  source 1..20: mol_type = other DNA
gtaatcatccatagctactt

SEQ ID NO: 2533 - DNA, 20 bp, synthetic construct
  source 1..20: mol_type = other DNA
aatacggcatctcggtaaaa

SEQ ID NO: 2534 - DNA, 20 bp, synthetic construct
  source 1..20: mol_type = other DNA
aagtccaaatgtgtcaaact

SEQ ID NO: 2535 - DNA, 20 bp, synthetic construct
  source 1..20: mol_type = other DNA
tgatctgattatggctaaat

SEQ ID NO: 2536 - DNA, 20 bp, synthetic construct
  source 1..20: mol_type = other DNA
gtctttggctttacatccta

SEQ ID NO: 2537 - DNA, 20 bp, synthetic construct
  source 1..20: mol_type = other DNA
ttttcaagttctacatagca

SEQ ID NO: 2538 - DNA, 20 bp, synthetic construct
  source 1..20: mol_type = other DNA
tgtgacatgtagttctttgg

SEQ ID NO: 2539 - DNA, 20 bp, synthetic construct
  source 1..20: mol_type = other DNA
gtgaaatctcaagtaatcga

SEQ ID NO: 2540 - DNA, 20 bp, synthetic construct
  source 1..20: mol_type = other DNA
atggtgagccttggttgatc

SEQ ID NO: 2541 - DNA, 20 bp, synthetic construct
  source 1..20: mol_type = other DNA
tgccgtagtcagcaatcttt

SEQ ID NO: 2542 - DNA, 20 bp, synthetic construct
  source 1..20: mol_type = other DNA
ttttctagggtatgtctctt

SEQ ID NO: 2543 - DNA, 20 bp, synthetic construct
  source 1..20: mol_type = other DNA
agcaagattgtatctctttc

SEQ ID NO: 2544 - DNA, 20 bp, synthetic construct
  source 1..20: mol_type = other DNA
aatgatgtaggatctgcagc

SEQ ID NO: 2545 - DNA, 20 bp, synthetic construct
  source 1..20: mol_type = other DNA
aatgagttgaagtgaaaaca

SEQ ID NO: 2546 - DNA, 20 bp, synthetic construct
  source 1..20: mol_type = other DNA
tatcaacagattaacaaaga

SEQ ID NO: 2547 - DNA, 20 bp, synthetic construct
  source 1..20: mol_type = other DNA
ttggtgaagcaacagtatca

SEQ ID NO: 2548 - DNA, 20 bp, synthetic construct
  source 1..20: mol_type = other DNA
tacagatgtgctgaaagtta

SEQ ID NO: 2549 - DNA, 20 bp, synthetic construct
  source 1..20: mol_type = other DNA
taaaaccaatgtattgaatg

SEQ ID NO: 2550 - DNA, 20 bp, synthetic construct
  source 1..20: mol_type = other DNA
ataactgtgttctacttttc

SEQ ID NO: 2551 - DNA, 20 bp, synthetic construct
  source 1..20: mol_type = other DNA
agacttaaaaatgaaagaca

SEQ ID NO: 2552 - DNA, 20 bp, synthetic construct
  source 1..20: mol_type = other DNA
aaaatataagtcttagggac

SEQ ID NO: 2553 - DNA, 20 bp, synthetic construct
  source 1..20: mol_type = other DNA
gtgcctaaaaaagaatgtat

SEQ ID NO: 2554 - DNA, 20 bp, synthetic construct
  source 1..20: mol_type = other DNA
agtagcatttccctgatcac

SEQ ID NO: 2555 - DNA, 20 bp, synthetic construct
  source 1..20: mol_type = other DNA
aaaaaaaaacctaatagacg

SEQ ID NO: 2556 - DNA, 20 bp, synthetic construct
  source 1..20: mol_type = other DNA
aaatatctctaacaacaatt

SEQ ID NO: 2557 - DNA, 20 bp, synthetic construct
  source 1..20: mol_type = other DNA
gtagccattttttctaaaaa

SEQ ID NO: 2558 - DNA, 20 bp, synthetic construct
  source 1..20: mol_type = other DNA
taatgattaaggaataattt

SEQ ID NO: 2559 - DNA, 20 bp, synthetic construct
  source 1..20: mol_type = other DNA
atcagaaccatgttctcact

SEQ ID NO: 2560 - DNA, 20 bp, synthetic construct
  source 1..20: mol_type = other DNA
ctatcatcctctgcaccaca

SEQ ID NO: 2561 - DNA, 20 bp, synthetic construct
  source 1..20: mol_type = other DNA
ccctcctccaactttcagtc

SEQ ID NO: 2562 - DNA, 20 bp, synthetic construct
  source 1..20: mol_type = other DNA
tatgtctttattcttaacat

SEQ ID NO: 2563 - DNA, 20 bp, synthetic construct
  source 1..20: mol_type = other DNA
tattcagctttctttgcttt

SEQ ID NO: 2564 - DNA, 20 bp, synthetic construct
  source 1..20: mol_type = other DNA
gatacttttaaatctaatag

SEQ ID NO: 2565 - DNA, 20 bp, synthetic construct
  source 1..20: mol_type = other DNA
cttcttttacctccaaaccc

SEQ ID NO: 2566 - DNA, 20 bp, synthetic construct
  source 1..20: mol_type = other DNA
aatggtgaataaccatgctg

SEQ ID NO: 2567 - DNA, 20 bp, synthetic construct
  source 1..20: mol_type = other DNA
cctaaaggaccctattactt

SEQ ID NO: 2568 - DNA, 20 bp, synthetic construct
  source 1..20: mol_type = other DNA
cagtgcccaggtggtaatga

SEQ ID NO: 2569 - DNA, 20 bp, synthetic construct
  source 1..20: mol_type = other DNA
tctctcagtcttcaaccttc

SEQ ID NO: 2570 - DNA, 20 bp, synthetic construct
  source 1..20: mol_type = other DNA
atgtgcaaaacactagtatc

SEQ ID NO: 2571 - DNA, 20 bp, synthetic construct
  source 1..20: mol_type = other DNA
attgtcaggaagcaaatgat

SEQ ID NO: 2572 - DNA, 20 bp, synthetic construct
  source 1..20: mol_type = other DNA
tgaaaaatatgaatacctca

SEQ ID NO: 2573 - DNA, 20 bp, synthetic construct
  source 1..20: mol_type = other DNA
acaatttaacttaccaagga

SEQ ID NO: 2574 - DNA, 20 bp, synthetic construct
  source 1..20: mol_type = other DNA
gatgaaactggcaccaagaa

SEQ ID NO: 2575 - DNA, 20 bp, synthetic construct
  source 1..20: mol_type = other DNA
gtgggtcacctttctttctt

SEQ ID NO: 2576 - DNA, 20 bp, synthetic construct
  source 1..20: mol_type = other DNA
atcaaagaggactcattaat

SEQ ID NO: 2577 - DNA, 20 bp, synthetic construct
  source 1..20: mol_type = other DNA
caaatctaccgtttctagga

SEQ ID NO: 2578 - DNA, 20 bp, synthetic construct
  source 1..20: mol_type = other DNA
gttaactagttgctatatga

SEQ ID NO: 2579 - DNA, 20 bp, synthetic construct
  source 1..20: mol_type = other DNA
actcggaaagtttcccaatt

SEQ ID NO: 2580 - DNA, 20 bp, synthetic construct
  source 1..20: mol_type = other DNA
gaataggaaagtctacaaat

SEQ ID NO: 2581 - DNA, 20 bp, synthetic construct
  source 1..20: mol_type = other DNA
taatatccagagtgccgtta

SEQ ID NO: 2582 - DNA, 20 bp, synthetic construct
  source 1..20: mol_type = other DNA
cttaactaaacccaaattct

SEQ ID NO: 2583 - DNA, 20 bp, synthetic construct
  source 1..20: mol_type = other DNA
tcagacaagttgctcttggt

SEQ ID NO: 2584 - DNA, 20 bp, synthetic construct
  source 1..20: mol_type = other DNA
aagaggtttgtatttaattt

SEQ ID NO: 2585 - DNA, 20 bp, synthetic construct
  source 1..20: mol_type = other DNA
cacttcataagtattgaagg

SEQ ID NO: 2586 - DNA, 20 bp, synthetic construct
  source 1..20: mol_type = other DNA
aatagttctcaccacataaa

SEQ ID NO: 2587 - DNA, 20 bp, synthetic construct
  source 1..20: mol_type = other DNA
tctcatatagtgccttgaaa

SEQ ID NO: 2588 - DNA, 20 bp, synthetic construct
  source 1..20: mol_type = other DNA
agtcatgttcaataaaaata

SEQ ID NO: 2589 - DNA, 20 bp, synthetic construct
  source 1..20: mol_type = other DNA
aggtgggaatattctaagta

SEQ ID NO: 2590 - DNA, 20 bp, synthetic construct
  source 1..20: mol_type = other DNA
ctacaaaagtttaccgagga

SEQ ID NO: 2591 - DNA, 20 bp, synthetic construct
  source 1..20: mol_type = other DNA
gaaagattcagataatcctt

SEQ ID NO: 2592 - DNA, 20 bp, synthetic construct
  source 1..20: mol_type = other DNA
ataatttctcacaagactta

SEQ ID NO: 2593 - DNA, 20 bp, synthetic construct
  source 1..20: mol_type = other DNA
gtaattttacttacaaataa

SEQ ID NO: 2594 - DNA, 20 bp, synthetic construct
  source 1..20: mol_type = other DNA
taagagaaatttatgaatta

SEQ ID NO: 2595 - DNA, 20 bp, synthetic construct
  source 1..20: mol_type = other DNA
aacctaaagacatccaatca

SEQ ID NO: 2596 - DNA, 20 bp, synthetic construct
  source 1..20: mol_type = other DNA
caacaggaccaaataggaat

SEQ ID NO: 2597 - DNA, 20 bp, synthetic construct
  source 1..20: mol_type = other DNA
gggaccctgagctaagacat

SEQ ID NO: 2598 - DNA, 20 bp, synthetic construct
  source 1..20: mol_type = other DNA
aaatggccttaatgttctcc

SEQ ID NO: 2599 - DNA, 20 bp, synthetic construct
  source 1..20: mol_type = other DNA
tttgtgactcaaagctaata

SEQ ID NO: 2600 - DNA, 20 bp, synthetic construct
  source 1..20: mol_type = other DNA
ccattttccccttttaaaca

SEQ ID NO: 2601 - DNA, 20 bp, synthetic construct
  source 1..20: mol_type = other DNA
aagaccatccatatgacact

SEQ ID NO: 2602 - DNA, 20 bp, synthetic construct
  source 1..20: mol_type = other DNA
aacagcttaacctttctata

SEQ ID NO: 2603 - DNA, 20 bp, synthetic construct
  source 1..20: mol_type = other DNA
gaggagatctaaggtcttca

SEQ ID NO: 2604 - DNA, 20 bp, synthetic construct
  source 1..20: mol_type = other DNA
atgaggacttccacattatt

SEQ ID NO: 2605 - DNA, 20 bp, synthetic construct
  source 1..20: mol_type = other DNA
acaggcttccagccaaaaca

SEQ ID NO: 2606 - DNA, 20 bp, synthetic construct
  source 1..20: mol_type = other DNA
ttcaggagaatgtatatgct

SEQ ID NO: 2607 - DNA, 20 bp, synthetic construct
  source 1..20: mol_type = other DNA
ataaaatgtaaaatagctcg

SEQ ID NO: 2608 - DNA, 20 bp, synthetic construct
  source 1..20: mol_type = other DNA
attctgatcacacgctctct

SEQ ID NO: 2609 - DNA, 20 bp, synthetic construct
  source 1..20: mol_type = other DNA
gtaatacggcatctcggtaa

SEQ ID NO: 2610 - DNA, 20 bp, synthetic construct
  source 1..20: mol_type = other DNA
caagtccaaatgtgtcaaac

SEQ ID NO: 2611 - DNA, 20 bp, synthetic construct
  source 1..20: mol_type = other DNA
ctgatctgattatggctaaa

SEQ ID NO: 2612 - DNA, 20 bp, synthetic construct
  source 1..20: mol_type = other DNA
ttttaccactcccagtattt

SEQ ID NO: 2613 - DNA, 20 bp, synthetic construct
  source 1..20: mol_type = other DNA
cacatttttacgctccgata

SEQ ID NO: 2614 - DNA, 20 bp, synthetic construct
  source 1..20: mol_type = other DNA
ctgtgacatgtagttctttg

SEQ ID NO: 2615 - DNA, 20 bp, synthetic construct
  source 1..20: mol_type = other DNA
cttcaggagaccaatttaag

SEQ ID NO: 2616 - DNA, 20 bp, synthetic construct
  source 1..20: mol_type = other DNA
aatggtgagccttggttgat

SEQ ID NO: 2617 - DNA, 20 bp, synthetic construct
  source 1..20: mol_type = other DNA
gccctctgatgtttttatcc

SEQ ID NO: 2618 - DNA, 20 bp, synthetic construct
  source 1..20: mol_type = other DNA
tcatcttttctagggtatgt

SEQ ID NO: 2619 - DNA, 20 bp, synthetic construct
  source 1..20: mol_type = other DNA
tttcagctaattcttttctc

SEQ ID NO: 2620 - DNA, 20 bp, synthetic construct
  source 1..20: mol_type = other DNA
gaaaagtgttagatatttat

SEQ ID NO: 2621 - DNA, 20 bp, synthetic construct
  source 1..20: mol_type = other DNA
gaatgagttgaagtgaaaac

SEQ ID NO: 2622 - DNA, 20 bp, synthetic construct
  source 1..20: mol_type = other DNA
atccagtaatctcatcgctg

SEQ ID NO: 2623 - DNA, 20 bp, synthetic construct
  source 1..20: mol_type = other DNA
attctgaacagcttctggtg

SEQ ID NO: 2624 - DNA, 20 bp, synthetic construct
  source 1..20: mol_type = other DNA
ttttcctggaaacacattct

SEQ ID NO: 2625 - DNA, 20 bp, synthetic construct
  source 1..20: mol_type = other DNA
aagggcaggaatgaccacta

SEQ ID NO: 2626 - DNA, 20 bp, synthetic construct
  source 1..20: mol_type = other DNA
gcaattgaagaaagtctact

SEQ ID NO: 2627 - DNA, 20 bp, synthetic construct
  source 1..20: mol_type = other DNA
gtttctccagcaccaagccc

SEQ ID NO: 2628 - DNA, 20 bp, synthetic construct
  source 1..20: mol_type = other DNA
ttccagaagggcaaccaatg

SEQ ID NO: 2629 - DNA, 20 bp, synthetic construct
  source 1..20: mol_type = other DNA
gaactggacaagttaatcct

SEQ ID NO: 2630 - DNA, 20 bp, synthetic construct
  source 1..20: mol_type = other DNA
tgctgttctagacaatttgg

SEQ ID NO: 2631 - DNA, 20 bp, synthetic construct
  source 1..20: mol_type = other DNA
aagccttggtcaattataaa

SEQ ID NO: 2632 - DNA, 20 bp, synthetic construct
  source 1..20: mol_type = other DNA
cacttgccattatcaaatat

SEQ ID NO: 2633 - DNA, 20 bp, synthetic construct
  source 1..20: mol_type = other DNA
tgtatgcaaccttgggacct

SEQ ID NO: 2634 - DNA, 20 bp, synthetic construct
  source 1..20: mol_type = other DNA
tggaaagcatttacatagaa

SEQ ID NO: 2635 - DNA, 20 bp, synthetic construct
  source 1..20: mol_type = other DNA
tgttaactgaaacttgtgca

SEQ ID NO: 2636 - DNA, 20 bp, synthetic construct
  source 1..20: mol_type = other DNA
tctatcatcctctgcaccac

SEQ ID NO: 2637 - DNA, 20 bp, synthetic construct
  source 1..20: mol_type = other DNA
taaggaaggcagccttgata

SEQ ID NO: 2638 - DNA, 20 bp, synthetic construct
  source 1..20: mol_type = other DNA
tttataaaaatgttcacact

SEQ ID NO: 2639 - DNA, 20 bp, synthetic construct
  source 1..20: mol_type = other DNA
aatctcatccatctgtaatt

SEQ ID NO: 2640 - DNA, 20 bp, synthetic construct
  source 1..20: mol_type = other DNA
tactctgatttcctcatctt

SEQ ID NO: 2641 - DNA, 20 bp, synthetic construct
  source 1..20: mol_type = other DNA
ctttacaatgtcttctttta

SEQ ID NO: 2642 - DNA, 20 bp, synthetic construct
  source 1..20: mol_type = other DNA
ataaatggtgaataaccatg

SEQ ID NO: 2643 - DNA, 20 bp, synthetic construct
  source 1..20: mol_type = other DNA
tggataacacctaaaggacc

SEQ ID NO: 2644 - DNA, 20 bp, synthetic construct
  source 1..20: mol_type = other DNA
gtatttggagcagtgcccag

SEQ ID NO: 2645 - DNA, 20 bp, synthetic construct
  source 1..20: mol_type = other DNA
gtaccttaacacagtaaata

SEQ ID NO: 2646 - DNA, 20 bp, synthetic construct
  source 1..20: mol_type = other DNA
taatctactatgtgcaaaac

SEQ ID NO: 2647 - DNA, 20 bp, synthetic construct
  source 1..20: mol_type = other DNA
tctacattgtcaggaagcaa

SEQ ID NO: 2648 - DNA, 20 bp, synthetic construct
  source 1..20: mol_type = other DNA
atctctcacagatgcaaaat

SEQ ID NO: 2649 - DNA, 20 bp, synthetic construct
  source 1..20: mol_type = other DNA
ataatcacaattgcacaatt

SEQ ID NO: 2650 - DNA, 20 bp, synthetic construct
  source 1..20: mol_type = other DNA
gaatcattaggtaaatatat

SEQ ID NO: 2651 - DNA, 20 bp, synthetic construct
  source 1..20: mol_type = other DNA
agtggagaagagagaaagac

SEQ ID NO: 2652 - DNA, 20 bp, synthetic construct
  source 1..20: mol_type = other DNA
tatcaaaaacaatttgcttt

SEQ ID NO: 2653 - DNA, 20 bp, synthetic construct
  source 1..20: mol_type = other DNA
acagtctcttttcttatctg

SEQ ID NO: 2654 - DNA, 20 bp, synthetic construct
  source 1..20: mol_type = other DNA
tttagtgtcaattctaaaaa

SEQ ID NO: 2655 - DNA, 20 bp, synthetic construct
  source 1..20: mol_type = other DNA
cagtagctataatgctttaa

SEQ ID NO: 2656 - DNA, 20 bp, synthetic construct
  source 1..20: mol_type = other DNA
tttagatttcatttaagaaa

SEQ ID NO: 2657 - DNA, 20 bp, synthetic construct
  source 1..20: mol_type = other DNA
aattacatgtccaacaagag

SEQ ID NO: 2658 - DNA, 20 bp, synthetic construct
  source 1..20: mol_type = other DNA
aataaaagtatcttccaaac

SEQ ID NO: 2659 - DNA, 20 bp, synthetic construct
  source 1..20: mol_type = other DNA
aaattcacaaaagtttctgc

SEQ ID NO: 2660 - DNA, 20 bp, synthetic construct
  source 1..20: mol_type = other DNA
tttcatatctcttttatcat

SEQ ID NO: 2661 - DNA, 20 bp, synthetic construct
  source 1..20: mol_type = other DNA
ttttgctttgtcaaattcac

SEQ ID NO: 2662 - DNA, 20 bp, synthetic construct
  source 1..20: mol_type = other DNA
ctataattgaatatactatt

SEQ ID NO: 2663 - DNA, 20 bp, synthetic construct
  source 1..20: mol_type = other DNA
attaaatcaatctaatgcat

SEQ ID NO: 2664 - DNA, 20 bp, synthetic construct
  source 1..20: mol_type = other DNA
ctcaatccccaaggagtttg

SEQ ID NO: 2665 - DNA, 20 bp, synthetic construct
  source 1..20: mol_type = other DNA
ctttcaccctgaacacacag

SEQ ID NO: 2666 - DNA, 20 bp, synthetic construct
  source 1..20: mol_type = other DNA
ctcaaccctcacccatgcag

SEQ ID NO: 2667 - DNA, 20 bp, synthetic construct
  source 1..20: mol_type = other DNA
cctgcttataatctctggtt

SEQ ID NO: 2668 - DNA, 20 bp, synthetic construct
  source 1..20: mol_type = other DNA
tctgaaggcttactatttta

SEQ ID NO: 2669 - DNA, 20 bp, synthetic construct
  source 1..20: mol_type = other DNA
actacagcatttcatgtgat

SEQ ID NO: 2670 - DNA, 20 bp, synthetic construct
  source 1..20: mol_type = other DNA
atgtatagccacctgtaatt

SEQ ID NO: 2671 - DNA, 20 bp, synthetic construct
  source 1..20: mol_type = other DNA
cttggataattatcataatg

SEQ ID NO: 2672 - DNA, 20 bp, synthetic construct
  source 1..20: mol_type = other DNA
tctcttgggttcatgcctga

SEQ ID NO: 2673 - DNA, 20 bp, synthetic construct
  source 1..20: mol_type = other DNA
taaatatttttgtagctcta

SEQ ID NO: 2674 - DNA, 20 bp, synthetic construct
  source 1..20: mol_type = other DNA
tgtttctagggaccctgagc

SEQ ID NO: 2675 - DNA, 20 bp, synthetic construct
  source 1..20: mol_type = other DNA
aaatgttgaaattgttacaa

SEQ ID NO: 2676 - DNA, 20 bp, synthetic construct
  source 1..20: mol_type = other DNA
aaatgacaattaggagggtc

SEQ ID NO: 2677 - DNA, 20 bp, synthetic construct
  source 1..20: mol_type = other DNA
cttgcaaaactttgtttcat

SEQ ID NO: 2678 - DNA, 20 bp, synthetic construct
  source 1..20: mol_type = other DNA
aatttataccagtcttatgt

SEQ ID NO: 2679 - DNA, 20 bp, synthetic construct
  source 1..20: mol_type = other DNA
attcttaattatgtgagtct

SEQ ID NO: 2680 - DNA, 20 bp, synthetic construct
  source 1..20: mol_type = other DNA
attttacctgaagttaggag

SEQ ID NO: 2681 - DNA, 20 bp, synthetic construct
  source 1..20: mol_type = other DNA
catgaggacttccacattat

SEQ ID NO: 2682 - DNA, 20 bp, synthetic construct
  source 1..20: mol_type = other DNA
ttatttagtgcccagcatgc

SEQ ID NO: 2683 - DNA, 20 bp, synthetic construct
  source 1..20: mol_type = other DNA
cttcaggagaatgtatatgc

SEQ ID NO: 2684 - DNA, 20 bp, synthetic construct
  source 1..20: mol_type = other DNA
attctgtatcctccctggat

SEQ ID NO: 2685 - DNA, 20 bp, synthetic construct
  source 1..20: mol_type = other DNA
ctgttattctgatcacacgc

SEQ ID NO: 2686 - DNA, 20 bp, synthetic construct
  source 1..20: mol_type = other DNA
tgtaatacggcatctcggta

SEQ ID NO: 2687 - DNA, 20 bp, synthetic construct
  source 1..20: mol_type = other DNA
gcaagtccaaatgtgtcaaa

SEQ ID NO: 2688 - DNA, 20 bp, synthetic construct
  source 1..20: mol_type = other DNA
gctgatctgattatggctaa

SEQ ID NO: 2689 - DNA, 20 bp, synthetic construct
  source 1..20: mol_type = other DNA
ggtggttttaccactcccag

SEQ ID NO: 2690 - DNA, 20 bp, synthetic construct
  source 1..20: mol_type = other DNA
ggcacatttttacgctccga

SEQ ID NO: 2691 - DNA, 20 bp, synthetic construct
  source 1..20: mol_type = other DNA
tactgtgacatgtagttctt

SEQ ID NO: 2692 - DNA, 20 bp, synthetic construct
  source 1..20: mol_type = other DNA
ataagcttcaggagaccaat

SEQ ID NO: 2693 - DNA, 20 bp, synthetic construct
  source 1..20: mol_type = other DNA
ggaatggtgagccttggttg

SEQ ID NO: 2694 - DNA, 20 bp, synthetic construct
  source 1..20: mol_type = other DNA
catttcctctggcaacttca

SEQ ID NO: 2695 - DNA, 20 bp, synthetic construct
  source 1..20: mol_type = other DNA
aattgcaatacaaacaagtg

SEQ ID NO: 2696 - DNA, 20 bp, synthetic construct
  source 1..20: mol_type = other DNA
ataattttcctatccaaaga

SEQ ID NO: 2697 - DNA, 20 bp, synthetic construct
  source 1..20: mol_type = other DNA
caactgaaaagtgttagata

SEQ ID NO: 2698 - DNA, 20 bp, synthetic construct
  source 1..20: mol_type = other DNA
atacttggaatagtcaagtc

SEQ ID NO: 2699 - DNA, 20 bp, synthetic construct
  source 1..20: mol_type = other DNA
tagcacagccatgatgaaac

SEQ ID NO: 2700 - DNA, 20 bp, synthetic construct
  source 1..20: mol_type = other DNA
ttggatcttttccagattaa

SEQ ID NO: 2701 - DNA, 20 bp, synthetic construct
  source 1..20: mol_type = other DNA
aaaagatttaaagttaatga

SEQ ID NO: 2702 - DNA, 20 bp, synthetic construct
  source 1..20: mol_type = other DNA
acttcagtgtttgtcactta

SEQ ID NO: 2703 - DNA, 20 bp, synthetic construct
  source 1..20: mol_type = other DNA
aatttctatgatttctggtg

SEQ ID NO: 2704 - DNA, 20 bp, synthetic construct
  source 1..20: mol_type = other DNA
actgagctacttttgtcttc

SEQ ID NO: 2705 - DNA, 20 bp, synthetic construct
  source 1..20: mol_type = other DNA
ttggagaatgacttttgcat

SEQ ID NO: 2706 - DNA, 20 bp, synthetic construct
  source 1..20: mol_type = other DNA
tgcatttctttatgaaaaca

SEQ ID NO: 2707 - DNA, 20 bp, synthetic construct
  source 1..20: mol_type = other DNA
aaagttacatatgacatgac

SEQ ID NO: 2708 - DNA, 20 bp, synthetic construct
  source 1..20: mol_type = other DNA
agaagccttggtcaattata

SEQ ID NO: 2709 - DNA, 20 bp, synthetic construct
  source 1..20: mol_type = other DNA
taactatctcaaattctcac

SEQ ID NO: 2710 - DNA, 20 bp, synthetic construct
  source 1..20: mol_type = other DNA
gatgtctaacatatcatatt

SEQ ID NO: 2711 - DNA, 20 bp, synthetic construct
  source 1..20: mol_type = other DNA
tcactcagctttttgggagt

SEQ ID NO: 2712 - DNA, 20 bp, synthetic construct
  source 1..20: mol_type = other DNA
ttgactagaatgcagtaggt

SEQ ID NO: 2713 - DNA, 20 bp, synthetic construct
  source 1..20: mol_type = other DNA
tgtatctagtctctctccct

SEQ ID NO: 2714 - DNA, 20 bp, synthetic construct
  source 1..20: mol_type = other DNA
ataatgttttccaaacctaa

SEQ ID NO: 2715 - DNA, 20 bp, synthetic construct
  source 1..20: mol_type = other DNA
ccattaattattttaaatag

SEQ ID NO: 2716 - DNA, 20 bp, synthetic construct
  source 1..20: mol_type = other DNA
aaatttccctccaacaaggt

SEQ ID NO: 2717 - DNA, 20 bp, synthetic construct
  source 1..20: mol_type = other DNA
atattagaagtgcaaatact

SEQ ID NO: 2718 - DNA, 20 bp, synthetic construct
  source 1..20: mol_type = other DNA
ctttaaaatcattcctttac

SEQ ID NO: 2719 - DNA, 20 bp, synthetic construct
  source 1..20: mol_type = other DNA
ttagcacattctctgaactt

SEQ ID NO: 2720 - DNA, 20 bp, synthetic construct
  source 1..20: mol_type = other DNA
aagattagactggataacac

SEQ ID NO: 2721 - DNA, 20 bp, synthetic construct
  source 1..20: mol_type = other DNA
acatttaaataataatgaag

SEQ ID NO: 2722 - DNA, 20 bp, synthetic construct
  source 1..20: mol_type = other DNA
atcaatgtcagaatagcatg

SEQ ID NO: 2723 - DNA, 20 bp, synthetic construct
  source 1..20: mol_type = other DNA
tgccaaattgtcctcaaaag

SEQ ID NO: 2724 - DNA, 20 bp, synthetic construct
  source 1..20: mol_type = other DNA
ctagagaaaacattaatcta

SEQ ID NO: 2725 - DNA, 20 bp, synthetic construct
  source 1..20: mol_type = other DNA
aaaatacctttacacaaatt

SEQ ID NO: 2726 - DNA, 20 bp, synthetic construct
  source 1..20: mol_type = other DNA
ttgttcctagctttggcata

SEQ ID NO: 2727 - DNA, 20 bp, synthetic construct
  source 1..20: mol_type = other DNA
atggaaggaatcattaggta

SEQ ID NO: 2728 - DNA, 20 bp, synthetic construct
  source 1..20: mol_type = other DNA
gtatttagcaaggcaaagaa

SEQ ID NO: 2729 - DNA, 20 bp, synthetic construct
  source 1..20: mol_type = other DNA
aaattgcataaattcatatg

SEQ ID NO: 2730 - DNA, 20 bp, synthetic construct
  source 1..20: mol_type = other DNA
ctgtgaaacacaatttggga

SEQ ID NO: 2731 - DNA, 20 bp, synthetic construct
  source 1..20: mol_type = other DNA
acatgatgtcagtagctata

SEQ ID NO: 2732 - DNA, 20 bp, synthetic construct
  source 1..20: mol_type = other DNA
ttcacactaaatggcccctg

SEQ ID NO: 2733 - DNA, 20 bp, synthetic construct
  source 1..20: mol_type = other DNA
taattggatgaataaatttt

SEQ ID NO: 2734 - DNA, 20 bp, synthetic construct
  source 1..20: mol_type = other DNA
taagaggatagtttctacaa

SEQ ID NO: 2735 - DNA, 20 bp, synthetic construct
  source 1..20: mol_type = other DNA
tggcttgaaaaccaagtcat

SEQ ID NO: 2736 - DNA, 20 bp, synthetic construct
  source 1..20: mol_type = other DNA
tctttcatatctcttttatc

SEQ ID NO: 2737 - DNA, 20 bp, synthetic construct
  source 1..20: mol_type = other DNA
tgatccttgtcatggcagtt

SEQ ID NO: 2738 - DNA, 20 bp, synthetic construct
  source 1..20: mol_type = other DNA
aatcaacattttctgaatct

SEQ ID NO: 2739 - DNA, 20 bp, synthetic construct
  source 1..20: mol_type = other DNA
tttatattaaatcaatctaa

SEQ ID NO: 2740 - DNA, 20 bp, synthetic construct
  source 1..20: mol_type = other DNA
aagagctctgctactccatc

SEQ ID NO: 2741 - DNA, 20 bp, synthetic construct
  source 1..20: mol_type = other DNA
taaagaacttgagaaggtga

SEQ ID NO: 2742 - DNA, 20 bp, synthetic construct
  source 1..20: mol_type = other DNA
ccactgttaactaacagtgt

SEQ ID NO: 2743 - DNA, 20 bp, synthetic construct
  source 1..20: mol_type = other DNA
ctatagccactactaatcag

SEQ ID NO: 2744 - DNA, 20 bp, synthetic construct
  source 1..20: mol_type = other DNA
attctgaaggcttactattt

SEQ ID NO: 2745 - DNA, 20 bp, synthetic construct
  source 1..20: mol_type = other DNA
ttctctgccccatgatgtca

SEQ ID NO: 2746 - DNA, 20 bp, synthetic construct
  source 1..20: mol_type = other DNA
ggtgatttaattgagttgca

SEQ ID NO: 2747 - DNA, 20 bp, synthetic construct
  source 1..20: mol_type = other DNA
taaatgttcaatgtattgtt

SEQ ID NO: 2748 - DNA, 20 bp, synthetic construct
  source 1..20: mol_type = other DNA
gagagatgagtagaaaggag

SEQ ID NO: 2749 - DNA, 20 bp, synthetic construct
  source 1..20: mol_type = other DNA
gcacattatctttaataaat

SEQ ID NO: 2750 - DNA, 20 bp, synthetic construct
  source 1..20: mol_type = other DNA
ataacccatctcaggctctg

SEQ ID NO: 2751 - DNA, 20 bp, synthetic construct
  source 1..20: mol_type = other DNA
ctactgtgttcaagatttta

SEQ ID NO: 2752 - DNA, 20 bp, synthetic construct
  source 1..20: mol_type = other DNA
agcacagatggcaaaaagct

SEQ ID NO: 2753 - DNA, 20 bp, synthetic construct
  source 1..20: mol_type = other DNA
gaaatattatatctgtaact

SEQ ID NO: 2754 - DNA, 20 bp, synthetic construct
  source 1..20: mol_type = other DNA
aatctgcttctcttgtggga

SEQ ID NO: 2755 - DNA, 20 bp, synthetic construct
  source 1..20: mol_type = other DNA
caaataccttggaactgaat

SEQ ID NO: 2756 - DNA, 20 bp, synthetic construct
  source 1..20: mol_type = other DNA
tctcaacaaattcagtcagt

SEQ ID NO: 2757 - DNA, 20 bp, synthetic construct
  source 1..20: mol_type = other DNA
ccactcatgaggacttccac

SEQ ID NO: 2758 - DNA, 20 bp, synthetic construct
  source 1..20: mol_type = other DNA
aggagattatttagtgccca

SEQ ID NO: 2759 - DNA, 20 bp, synthetic construct
  source 1..20: mol_type = other DNA
gccacttcaggagaatgtat

SEQ ID NO: 2760 - DNA, 20 bp, synthetic construct
  source 1..20: mol_type = other DNA
atatttagcttatgatgaaa

SEQ ID NO: 2761 - DNA, 20 bp, synthetic construct
  source 1..20: mol_type = other DNA
acctttcccaatgcttatcg

SEQ ID NO: 2762 - DNA, 20 bp, synthetic construct
  source 1..20: mol_type = other DNA
gcaaatttggtgagcaacgc

SEQ ID NO: 2763 - DNA, 20 bp, synthetic construct
  source 1..20: mol_type = other DNA
atcaagattagcaatacaac

SEQ ID NO: 2764 - DNA, 20 bp, synthetic construct
  source 1..20: mol_type = other DNA
caagatgctgatctgattat

SEQ ID NO: 2765 - DNA, 20 bp, synthetic construct
  source 1..20: mol_type = other DNA
tatagaattcctcacgacct

SEQ ID NO: 2766 - DNA, 20 bp, synthetic construct
  source 1..20: mol_type = other DNA
caattggcacatttttacgc

SEQ ID NO: 2767 - DNA, 20 bp, synthetic construct
  source 1..20: mol_type = other DNA
taaaatactgtgacatgtag

SEQ ID NO: 2768 - DNA, 20 bp, synthetic construct
  source 1..20: mol_type = other DNA
ccacaacttggcccaaaaga

SEQ ID NO: 2769 - DNA, 20 bp, synthetic construct
  source 1..20: mol_type = other DNA
gtcagccaaaatcaagtcag

SEQ ID NO: 2770 - DNA, 20 bp, synthetic construct
  source 1..20: mol_type = other DNA
ggtaattttccttgtatttc

SEQ ID NO: 2771 - DNA, 20 bp, synthetic construct
  source 1..20: mol_type = other DNA
ggagtactgacatttcctat

SEQ ID NO: 2772 - DNA, 20 bp, synthetic construct
  source 1..20: mol_type = other DNA
ataagaaatataacattgtg

SEQ ID NO: 2773 - DNA, 20 bp, synthetic construct
  source 1..20: mol_type = other DNA
cctcaaattattacataggt

SEQ ID NO: 2774 - DNA, 20 bp, synthetic construct
  source 1..20: mol_type = other DNA
taagacatcactttctttag

SEQ ID NO: 2775 - DNA, 20 bp, synthetic construct
  source 1..20: mol_type = other DNA
gaatcaaatattggctgtgc

SEQ ID NO: 2776 - DNA, 20 bp, synthetic construct
  source 1..20: mol_type = other DNA
catatatgtaccctctagag

SEQ ID NO: 2777 - DNA, 20 bp, synthetic construct
  source 1..20: mol_type = other DNA
ctgatacatagaattacaga

SEQ ID NO: 2778 - DNA, 20 bp, synthetic construct
  source 1..20: mol_type = other DNA
gccaaagttttctcagggaa

SEQ ID NO: 2779 - DNA, 20 bp, synthetic construct
  source 1..20: mol_type = other DNA
gggcccacataaatcattct

SEQ ID NO: 2780 - DNA, 20 bp, synthetic construct
  source 1..20: mol_type = other DNA
ctctccactccatgtctctg

SEQ ID NO: 2781 - DNA, 20 bp, synthetic construct
  source 1..20: mol_type = other DNA
acaataatgtaacatatttt

SEQ ID NO: 2782 - DNA, 20 bp, synthetic construct
  source 1..20: mol_type = other DNA
agcaaacatttaaaagccca

SEQ ID NO: 2783 - DNA, 20 bp, synthetic construct
  source 1..20: mol_type = other DNA
cataattagattacatagtt

SEQ ID NO: 2784 - DNA, 20 bp, synthetic construct
  source 1..20: mol_type = other DNA
tttatgagagtcctacctgc

SEQ ID NO: 2785 - DNA, 20 bp, synthetic construct
  source 1..20: mol_type = other DNA
tagaagtccggaaaaatata

SEQ ID NO: 2786 - DNA, 20 bp, synthetic construct
  source 1..20: mol_type = other DNA
tcttactcaatagtcacctt

SEQ ID NO: 2787 - DNA, 20 bp, synthetic construct
  source 1..20: mol_type = other DNA
ttagaatattaatatagtcc

SEQ ID NO: 2788 - DNA, 20 bp, synthetic construct
  source 1..20: mol_type = other DNA
actgatctgattcaatggta

SEQ ID NO: 2789 - DNA, 20 bp, synthetic construct
  source 1..20: mol_type = other DNA
cagaacaaagtatcatccct

SEQ ID NO: 2790 - DNA, 20 bp, synthetic construct
  source 1..20: mol_type = other DNA
ctttattaagctacactgta

SEQ ID NO: 2791 - DNA, 20 bp, synthetic construct
  source 1..20: mol_type = other DNA
agataaatttaacccattac

SEQ ID NO: 2792 - DNA, 20 bp, synthetic construct
  source 1..20: mol_type = other DNA
acgaatcatgccacagtgaa

SEQ ID NO: 2793 - DNA, 20 bp, synthetic construct
  source 1..20: mol_type = other DNA
tactagaacacagtgaaatg

SEQ ID NO: 2794 - DNA, 20 bp, synthetic construct
  source 1..20: mol_type = other DNA
aatacatagtctcccttgac

SEQ ID NO: 2795 - DNA, 20 bp, synthetic construct
  source 1..20: mol_type = other DNA
attcttaatctcccgtgaac

SEQ ID NO: 2796 - DNA, 20 bp, synthetic construct
  source 1..20: mol_type = other DNA
catggttcaggagggaagag

SEQ ID NO: 2797 - DNA, 20 bp, synthetic construct
  source 1..20: mol_type = other DNA
tccttggaggatccaaacta

SEQ ID NO: 2798 - DNA, 20 bp, synthetic construct
  source 1..20: mol_type = other DNA
tcataaagaacttaaatgtc

SEQ ID NO: 2799 - DNA, 20 bp, synthetic construct
  source 1..20: mol_type = other DNA
atgggaaattatcccgaagc

SEQ ID NO: 2800 - DNA, 20 bp, synthetic construct
  source 1..20: mol_type = other DNA
caaaatacttcaacacttca

SEQ ID NO: 2801 - DNA, 20 bp, synthetic construct
  source 1..20: mol_type = other DNA
aatataacaaaaatctgatt

SEQ ID NO: 2802 - DNA, 20 bp, synthetic construct
  source 1..20: mol_type = other DNA
aacccacaccattaggtaga

SEQ ID NO: 2803 - DNA, 20 bp, synthetic construct
  source 1..20: mol_type = other DNA
tgcaaaaaccagaggcacgg

SEQ ID NO: 2804 - DNA, 20 bp, synthetic construct
  source 1..20: mol_type = other DNA
ttttaaatcaaattggatga

SEQ ID NO: 2805 - DNA, 20 bp, synthetic construct
  source 1..20: mol_type = other DNA
cccctctatagtatacaaaa

SEQ ID NO: 2806 - DNA, 20 bp, synthetic construct
  source 1..20: mol_type = other DNA
ttaacctggaagctaaacag

SEQ ID NO: 2807 - DNA, 20 bp, synthetic construct
  source 1..20: mol_type = other DNA
tgagaggtgatgacagagct

SEQ ID NO: 2808 - DNA, 20 bp, synthetic construct
  source 1..20: mol_type = other DNA
tgcacagaagagttcattgc

SEQ ID NO: 2809 - DNA, 20 bp, synthetic construct
  source 1..20: mol_type = other DNA
taaaaagttgtcttcaaagg

SEQ ID NO: 2810 - DNA, 20 bp, synthetic construct
  source 1..20: mol_type = other DNA
cttggttatttgtaaaatgt

SEQ ID NO: 2811 - DNA, 20 bp, synthetic construct
  source 1..20: mol_type = other DNA
ttatgtcaaagctacagaga

SEQ ID NO: 2812 - DNA, 20 bp, synthetic construct
  source 1..20: mol_type = other DNA
ttttccaaattcctttgtat

SEQ ID NO: 2813 - DNA, 20 bp, synthetic construct
  source 1..20: mol_type = other DNA
gaaacaatgaacatcagtat

SEQ ID NO: 2814 - DNA, 20 bp, synthetic construct
  source 1..20: mol_type = other DNA
aactgctgcagactaccaga

SEQ ID NO: 2815 - DNA, 20 bp, synthetic construct
  source 1..20: mol_type = other DNA
agcatttaaattcaacctaa

SEQ ID NO: 2816 - DNA, 20 bp, synthetic construct
  source 1..20: mol_type = other DNA
gtaaggttgagaacaagtgc

SEQ ID NO: 2817 - DNA, 20 bp, synthetic construct
  source 1..20: mol_type = other DNA
agtagattctgttatacaaa

SEQ ID NO: 2818 - DNA, 20 bp, synthetic construct
  source 1..20: mol_type = other DNA
aaaagagattatgtcagatt

SEQ ID NO: 2819 - DNA, 20 bp, synthetic construct
  source 1..20: mol_type = other DNA
gtactgtcagaattaaattt

SEQ ID NO: 2820 - DNA, 20 bp, synthetic construct
  source 1..20: mol_type = other DNA
gatttgttatttaaagtaag

SEQ ID NO: 2821 - DNA, 20 bp, synthetic construct
  source 1..20: mol_type = other DNA
acagtgtaaagttttcatct

SEQ ID NO: 2822 - DNA, 20 bp, synthetic construct
  source 1..20: mol_type = other DNA
gagttgcatatggtttagga

SEQ ID NO: 2823 - DNA, 20 bp, synthetic construct
  source 1..20: mol_type = other DNA
ttctcatccagtgcacacat

SEQ ID NO: 2824 - DNA, 20 bp, synthetic construct
  source 1..20: mol_type = other DNA
cctgaaagtaagcagataaa

SEQ ID NO: 2825 - DNA, 20 bp, synthetic construct
  source 1..20: mol_type = other DNA
aattcatgccattccagaat

SEQ ID NO: 2826 - DNA, 20 bp, synthetic construct
  source 1..20: mol_type = other DNA
ataagaagattgttcctctc

SEQ ID NO: 2827 - DNA, 20 bp, synthetic construct
  source 1..20: mol_type = other DNA
agagaaataaatgctcatgg

SEQ ID NO: 2828 - DNA, 20 bp, synthetic construct
  source 1..20: mol_type = other DNA
tatggaactttaaagagtta

SEQ ID NO: 2829 - DNA, 20 bp, synthetic construct
  source 1..20: mol_type = other DNA
actttacttacttttggtta

SEQ ID NO: 2830 - DNA, 20 bp, synthetic construct
  source 1..20: mol_type = other DNA
agactatgattaaaacaaac

SEQ ID NO: 2831 - DNA, 20 bp, synthetic construct
  source 1..20: mol_type = other DNA
acatcattgccctgtttgga

SEQ ID NO: 2832 - DNA, 20 bp, synthetic construct
  source 1..20: mol_type = other DNA
tttgttctcaacaaattcag

SEQ ID NO: 2833 - DNA, 20 bp, synthetic construct
  source 1..20: mol_type = other DNA
gccactcatgaggacttcca

SEQ ID NO: 2834 - DNA, 20 bp, synthetic construct
  source 1..20: mol_type = other DNA
aaggagattatttagtgccc

SEQ ID NO: 2835 - DNA, 20 bp, synthetic construct
  source 1..20: mol_type = other DNA
cagccacttcaggagaatgt

SEQ ID NO: 2836 - DNA, 20 bp, synthetic construct
  source 1..20: mol_type = other DNA
catatttagcttatgatgaa

SEQ ID NO: 2837 - DNA, 20 bp, synthetic construct
  source 1..20: mol_type = other DNA
cacctttcccaatgcttatc

SEQ ID NO: 2838 - DNA, 20 bp, synthetic construct
  source 1..20: mol_type = other DNA
ttcatgatcaaaaatgggcc

SEQ ID NO: 2839 - DNA, 20 bp, synthetic construct
  source 1..20: mol_type = other DNA
atctaaaaccactgagggtc

SEQ ID NO: 2840 - DNA, 20 bp, synthetic construct
  source 1..20: mol_type = other DNA
accataaatatgctttttca

SEQ ID NO: 2841 - DNA, 20 bp, synthetic construct
  source 1..20: mol_type = other DNA
actatagaattcctcacgac

SEQ ID NO: 2842 - DNA, 20 bp, synthetic construct
  source 1..20: mol_type = other DNA
tcaattggcacatttttacg

SEQ ID NO: 2843 - DNA, 20 bp, synthetic construct
  source 1..20: mol_type = other DNA
tttttctaggagcttaaaat

SEQ ID NO: 2844 - DNA, 20 bp, synthetic construct
  source 1..20: mol_type = other DNA
tccacaacttggcccaaaag

SEQ ID NO: 2845 - DNA, 20 bp, synthetic construct
  source 1..20: mol_type = other DNA
ggtcagccaaaatcaagtca

SEQ ID NO: 2846 - DNA, 20 bp, synthetic construct
  source 1..20: mol_type = other DNA
atttctttccgttgaatttg

SEQ ID NO: 2847 - DNA, 20 bp, synthetic construct
  source 1..20: mol_type = other DNA
atcggccttataaattttag

SEQ ID NO: 2848 - DNA, 20 bp, synthetic construct
  source 1..20: mol_type = other DNA
aagaatttaccgaaagtact

SEQ ID NO: 2849 - DNA, 20 bp, synthetic construct
  source 1..20: mol_type = other DNA
aaatttctgggtttcctatg

SEQ ID NO: 2850 - DNA, 20 bp, synthetic construct
  source 1..20: mol_type = other DNA
agctctttgatcctcagtga

SEQ ID NO: 2851 - DNA, 20 bp, synthetic construct
  source 1..20: mol_type = other DNA
aaaaagagaaagtgcatata

SEQ ID NO: 2852 - DNA, 20 bp, synthetic construct
  source 1..20: mol_type = other DNA
tgtacaggaatatgactaga

SEQ ID NO: 2853 - DNA, 20 bp, synthetic construct
  source 1..20: mol_type = other DNA
tccagcctctctcatgctat

SEQ ID NO: 2854 - DNA, 20 bp, synthetic construct
  source 1..20: mol_type = other DNA
tgataactgacacagggccc

SEQ ID NO: 2855 - DNA, 20 bp, synthetic construct
  source 1..20: mol_type = other DNA
ggcccttcatgctctccact

SEQ ID NO: 2856 - DNA, 20 bp, synthetic construct
  source 1..20: mol_type = other DNA
agataaataaattggagggt

SEQ ID NO: 2857 - DNA, 20 bp, synthetic construct
  source 1..20: mol_type = other DNA
atatttttaagcccacattg

SEQ ID NO: 2858 - DNA, 20 bp, synthetic construct
  source 1..20: mol_type = other DNA
tcatcaacggcctcacaatc

SEQ ID NO: 2859 - DNA, 20 bp, synthetic construct
  source 1..20: mol_type = other DNA
aattttgaataactctaata

SEQ ID NO: 2860 - DNA, 20 bp, synthetic construct
  source 1..20: mol_type = other DNA
atgtcatgtgtgagtttaca

SEQ ID NO: 2861 - DNA, 20 bp, synthetic construct
  source 1..20: mol_type = other DNA
ggtcttactcaatagtcacc

SEQ ID NO: 2862 - DNA, 20 bp, synthetic construct
  source 1..20: mol_type = other DNA
acttatagatatgaaagcat

SEQ ID NO: 2863 - DNA, 20 bp, synthetic construct
  source 1..20: mol_type = other DNA
aaagatttacatttagtcga

SEQ ID NO: 2864 - DNA, 20 bp, synthetic construct
  source 1..20: mol_type = other DNA
atataactagagaaaatgat

SEQ ID NO: 2865 - DNA, 20 bp, synthetic construct
  source 1..20: mol_type = other DNA
aagttctgtaaaggctatat

SEQ ID NO: 2866 - DNA, 20 bp, synthetic construct
  source 1..20: mol_type = other DNA
aaagaaaagaaccaaggttt

SEQ ID NO: 2867 - DNA, 20 bp, synthetic construct
  source 1..20: mol_type = other DNA
gcatttagtttgttgccaca

SEQ ID NO: 2868 - DNA, 20 bp, synthetic construct
  source 1..20: mol_type = other DNA
ctaataaagtggatggattt

SEQ ID NO: 2869 - DNA, 20 bp, synthetic construct
  source 1..20: mol_type = other DNA
tatcatcttaataatacata

SEQ ID NO: 2870 - DNA, 20 bp, synthetic construct
  source 1..20: mol_type = other DNA
ctcttgaagaaaaactattt

SEQ ID NO: 2871 - DNA, 20 bp, synthetic construct
  source 1..20: mol_type = other DNA
agaacaatcagatagatata

SEQ ID NO: 2872 - DNA, 20 bp, synthetic construct
  source 1..20: mol_type = other DNA
tttgtggaaggaattttcct

SEQ ID NO: 2873 - DNA, 20 bp, synthetic construct
  source 1..20: mol_type = other DNA
gtaccccttcaaaaagcttc

SEQ ID NO: 2874 - DNA, 20 bp, synthetic construct
  source 1..20: mol_type = other DNA
cactatacccatatacccaa

SEQ ID NO: 2875 - DNA, 20 bp, synthetic construct
  source 1..20: mol_type = other DNA
gaaaactgcatttcaccaag

SEQ ID NO: 2876 - DNA, 20 bp, synthetic construct
  source 1..20: mol_type = other DNA
ttatccagaaaatctccaaa

SEQ ID NO: 2877 - DNA, 20 bp, synthetic construct
  source 1..20: mol_type = other DNA
tccatagttccaaaacagac

SEQ ID NO: 2878 - DNA, 20 bp, synthetic construct
  source 1..20: mol_type = other DNA
caaagatgctcctgaacatc

SEQ ID NO: 2879 - DNA, 20 bp, synthetic construct
  source 1..20: mol_type = other DNA
cactgggaatagacagaaac

SEQ ID NO: 2880 - DNA, 20 bp, synthetic construct
  source 1..20: mol_type = other DNA
ggttttgacaagtgtaccat

SEQ ID NO: 2881 - DNA, 20 bp, synthetic construct
  source 1..20: mol_type = other DNA
accaatagtgtgtcacttaa

SEQ ID NO: 2882 - DNA, 20 bp, synthetic construct
  source 1..20: mol_type = other DNA
actagcattattgacatatg

SEQ ID NO: 2883 - DNA, 20 bp, synthetic construct
  source 1..20: mol_type = other DNA
tagtgagtgaacacagccat

SEQ ID NO: 2884 - DNA, 20 bp, synthetic construct
  source 1..20: mol_type = other DNA
tcctgacacaagctttttaa

SEQ ID NO: 2885 - DNA, 20 bp, synthetic construct
  source 1..20: mol_type = other DNA
ctggtatttctcaaagcatt

SEQ ID NO: 2886 - DNA, 20 bp, synthetic construct
  source 1..20: mol_type = other DNA
ttttaaatattcaaggtaaa

SEQ ID NO: 2887 - DNA, 20 bp, synthetic construct
  source 1..20: mol_type = other DNA
aatgtgcaacaaagaattat

SEQ ID NO: 2888 - DNA, 20 bp, synthetic construct
  source 1..20: mol_type = other DNA
cattatcttgactttatcac

SEQ ID NO: 2889 - DNA, 20 bp, synthetic construct
  source 1..20: mol_type = other DNA
tagcaattaattttttaagg

SEQ ID NO: 2890 - DNA, 20 bp, synthetic construct
  source 1..20: mol_type = other DNA
agaagtaataaaacattttt

SEQ ID NO: 2891 - DNA, 20 bp, synthetic construct
  source 1..20: mol_type = other DNA
gggagagtaatcacaaacat

SEQ ID NO: 2892 - DNA, 20 bp, synthetic construct
  source 1..20: mol_type = other DNA
tctcctgttcagaaacaaat

SEQ ID NO: 2893 - DNA, 20 bp, synthetic construct
  source 1..20: mol_type = other DNA
gtttagagcagtaagtcatg

SEQ ID NO: 2894 - DNA, 20 bp, synthetic construct
  source 1..20: mol_type = other DNA
taaaatttgaaatgcatgct

SEQ ID NO: 2895 - DNA, 20 bp, synthetic construct
  source 1..20: mol_type = other DNA
tacttaacgaagattaaata

SEQ ID NO: 2896 - DNA, 20 bp, synthetic construct
  source 1..20: mol_type = other DNA
caaatgcatacttgctttcg

SEQ ID NO: 2897 - DNA, 20 bp, synthetic construct
  source 1..20: mol_type = other DNA
aacagtgtaaagttttcatc

SEQ ID NO: 2898 - DNA, 20 bp, synthetic construct
  source 1..20: mol_type = other DNA
agagttgcatatggtttagg

SEQ ID NO: 2899 - DNA, 20 bp, synthetic construct
  source 1..20: mol_type = other DNA
ttctaaattctcatccagtg

SEQ ID NO: 2900 - DNA, 20 bp, synthetic construct
  source 1..20: mol_type = other DNA
atgatcatctgtttaaggaa

SEQ ID NO: 2901 - DNA, 20 bp, synthetic construct
  source 1..20: mol_type = other DNA
agcataaacaagaaggagaa

SEQ ID NO: 2902 - DNA, 20 bp, synthetic construct
  source 1..20: mol_type = other DNA
agttttgcctatcaagatga

SEQ ID NO: 2903 - DNA, 20 bp, synthetic construct
  source 1..20: mol_type = other DNA
cctaagcacccatgaatgaa

SEQ ID NO: 2904 - DNA, 20 bp, synthetic construct
  source 1..20: mol_type = other DNA
aatctcttttgggagatgag

SEQ ID NO: 2905 - DNA, 20 bp, synthetic construct
  source 1..20: mol_type = other DNA
taaccattctgaattgaata

SEQ ID NO: 2906 - DNA, 20 bp, synthetic construct
  source 1..20: mol_type = other DNA
aattattatcaaaggaagac

SEQ ID NO: 2907 - DNA, 20 bp, synthetic construct
  source 1..20: mol_type = other DNA
aatttatgaaacacataata

SEQ ID NO: 2908 - DNA, 20 bp, synthetic construct
  source 1..20: mol_type = other DNA
acctgctgcacactcgcgac

SEQ ID NO: 2909 - DNA, 20 bp, synthetic construct
  source 1..20: mol_type = other DNA
acttccacattattgcaagg

SEQ ID NO: 2910 - DNA, 20 bp, synthetic construct
  source 1..20: mol_type = other DNA
cgctgagatctgcaatgctg

SEQ ID NO: 2911 - DNA, 20 bp, synthetic construct
  source 1..20: mol_type = other DNA
agaatgtatatgcttctgca

SEQ ID NO: 2912 - DNA, 20 bp, synthetic construct
  source 1..20: mol_type = other DNA
agcattttacagccactttc

SEQ ID NO: 2913 - DNA, 20 bp, synthetic construct
  source 1..20: mol_type = other DNA
aagatgctgacaatttgagg

SEQ ID NO: 2914 - DNA, 20 bp, synthetic construct
  source 1..20: mol_type = other DNA
atttagacagcacatcttca

SEQ ID NO: 2915 - DNA, 20 bp, synthetic construct
  source 1..20: mol_type = other DNA
caaatgtgtcaaactcttca

SEQ ID NO: 2916 - DNA, 20 bp, synthetic construct
  source 1..20: mol_type = other DNA
cagtgtgcgggacctggtag

SEQ ID NO: 2917 - DNA, 20 bp, synthetic construct
  source 1..20: mol_type = other DNA
atttccccatttcattggga

SEQ ID NO: 2918 - DNA, 20 bp, synthetic construct
  source 1..20: mol_type = other DNA
cgaagttttgccaaagcatc

SEQ ID NO: 2919 - DNA, 20 bp, synthetic construct
  source 1..20: mol_type = other DNA
ttttggacaaccttccactt

SEQ ID NO: 2920 - DNA, 20 bp, synthetic construct
  source 1..20: mol_type = other DNA
aaggcatttcatatagtcgg

SEQ ID NO: 2921 - DNA, 20 bp, synthetic construct
  source 1..20: mol_type = other DNA
gagccttggttgatctggat

SEQ ID NO: 2922 - DNA, 20 bp, synthetic construct
  source 1..20: mol_type = other DNA
tggctgagtggaggtatctc

SEQ ID NO: 2923 - DNA, 20 bp, synthetic construct
  source 1..20: mol_type = other DNA
tttcaacaggaagatgcacc

SEQ ID NO: 2924 - DNA, 20 bp, synthetic construct
  source 1..20: mol_type = other DNA
agctgtgctgtcatcatgac

SEQ ID NO: 2925 - DNA, 20 bp, synthetic construct
  source 1..20: mol_type = other DNA
aaaaatatcacttgaaggac

SEQ ID NO: 2926 - DNA, 20 bp, synthetic construct
  source 1..20: mol_type = other DNA
tttacctgctgcacactcgc

SEQ ID NO: 2927 - DNA, 20 bp, synthetic construct
  source 1..20: mol_type = other DNA
tatacatgtatcaaatagca

SEQ ID NO: 2928 - DNA, 20 bp, synthetic construct
  source 1..20: mol_type = other DNA
atctctctaagagagaaggt

SEQ ID NO: 2929 - DNA, 20 bp, synthetic construct
  source 1..20: mol_type = other DNA
tctcttcatggtttgaattc

SEQ ID NO: 2930 - DNA, 20 bp, synthetic construct
  source 1..20: mol_type = other DNA
aagtttgcttatttgcattt

SEQ ID NO: 2931 - DNA, 20 bp, synthetic construct
  source 1..20: mol_type = other DNA
taatttcatgagtctcaatc

SEQ ID NO: 2932 - DNA, 20 bp, synthetic construct
  source 1..20: mol_type = other DNA
catgtataaaattatagttt

SEQ ID NO: 2933 - DNA, 20 bp, synthetic construct
  source 1..20: mol_type = other DNA
caatgtgggtggaaaacaat

SEQ ID NO: 2934 - DNA, 20 bp, synthetic construct
  source 1..20: mol_type = other DNA
atagacaatgacccttgctc

SEQ ID NO: 2935 - DNA, 20 bp, synthetic construct
  source 1..20: mol_type = other DNA
ttctcatgaaaaataatgaa

SEQ ID NO: 2936 - DNA, 20 bp, synthetic construct
  source 1..20: mol_type = other DNA
tgagctacacaggacagaaa

SEQ ID NO: 2937 - DNA, 20 bp, synthetic construct
  source 1..20: mol_type = other DNA
caaaagcatatgcagcagag

SEQ ID NO: 2938 - DNA, 20 bp, synthetic construct
  source 1..20: mol_type = other DNA
atcaaaggagatttccaggt

SEQ ID NO: 2939 - DNA, 20 bp, synthetic construct
  source 1..20: mol_type = other DNA
aataagtagtctatcttaag

SEQ ID NO: 2940 - DNA, 20 bp, synthetic construct
  source 1..20: mol_type = other DNA
tccgctgtgtttttgcctca

SEQ ID NO: 2941 - DNA, 20 bp, synthetic construct
  source 1..20: mol_type = other DNA
atgcctcactcacccccgac

SEQ ID NO: 2942 - DNA, 20 bp, synthetic construct
  source 1..20: mol_type = other DNA
aagaagatgtgaccactaaa

SEQ ID NO: 2943 - DNA, 20 bp, synthetic construct
  source 1..20: mol_type = other DNA
gtaattcccttcttctcttt

SEQ ID NO: 2944 - DNA, 20 bp, synthetic construct
  source 1..20: mol_type = other DNA
aatactattgttatttttac

SEQ ID NO: 2945 - DNA, 20 bp, synthetic construct
  source 1..20: mol_type = other DNA
cagggtgcatagtctgtagg

SEQ ID NO: 2946 - DNA, 20 bp, synthetic construct
  source 1..20: mol_type = other DNA
tctgaactttctgtttgatt

SEQ ID NO: 2947 - DNA, 20 bp, synthetic construct
  source 1..20: mol_type = other DNA
gccctacaaaaatctattct

SEQ ID NO: 2948 - DNA, 20 bp, synthetic construct
  source 1..20: mol_type = other DNA
ggatgcaagtgaaaaacact

SEQ ID NO: 2949 - DNA, 20 bp, synthetic construct
  source 1..20: mol_type = other DNA
ctagatataaataacctctg

SEQ ID NO: 2950 - DNA, 20 bp, synthetic construct
  source 1..20: mol_type = other DNA
ataatatccatcagttactg

SEQ ID NO: 2951 - DNA, 20 bp, synthetic construct
  source 1..20: mol_type = other DNA
gaagagacagccaggtgaag

SEQ ID NO: 2952 - DNA, 20 bp, synthetic construct
  source 1..20: mol_type = other DNA
acaatattttggaacaactc

SEQ ID NO: 2953 - DNA, 20 bp, synthetic construct
  source 1..20: mol_type = other DNA
ataggtaatatgatttaatt

SEQ ID NO: 2954 - DNA, 20 bp, synthetic construct
  source 1..20: mol_type = other DNA
tcatgtttcatggtttcttt

SEQ ID NO: 2955 - DNA, 20 bp, synthetic construct
  source 1..20: mol_type = other DNA
ggaaggaaccatgaaatttt

SEQ ID NO: 2956 - DNA, 20 bp, synthetic construct
  source 1..20: mol_type = other DNA
ccttgagaatttaacaattt

SEQ ID NO: 2957 - DNA, 20 bp, synthetic construct
  source 1..20: mol_type = other DNA
ctctttcttacccttctaaa

SEQ ID NO: 2958 - DNA, 20 bp, synthetic construct
  source 1..20: mol_type = other DNA
gcaaagcaaacagattttga

SEQ ID NO: 2959 - DNA, 20 bp, synthetic construct
  source 1..20: mol_type = other DNA
tcactcatctgtaatattaa

SEQ ID NO: 2960 - DNA, 20 bp, synthetic construct
  source 1..20: mol_type = other DNA
ctaacatatccctccatgtt

SEQ ID NO: 2961 - DNA, 20 bp, synthetic construct
  source 1..20: mol_type = other DNA
ccataaaacaggaattccaa

SEQ ID NO: 2962 - DNA, 20 bp, synthetic construct
  source 1..20: mol_type = other DNA
atctcttaacccagagaatt

SEQ ID NO: 2963 - DNA, 20 bp, synthetic construct
  source 1..20: mol_type = other DNA
atatttgagacactgacatg

SEQ ID NO: 2964 - DNA, 20 bp, synthetic construct
  source 1..20: mol_type = other DNA
aattactccacagaatcttc

SEQ ID NO: 2965 - DNA, 20 bp, synthetic construct
  source 1..20: mol_type = other DNA
aattctaactctacctcttc

SEQ ID NO: 2966 - DNA, 20 bp, synthetic construct
  source 1..20: mol_type = other DNA
taaaaagaagtttttgatca

SEQ ID NO: 2967 - DNA, 20 bp, synthetic construct
  source 1..20: mol_type = other DNA
atgtgcaggaagtcaagata

SEQ ID NO: 2968 - DNA, 20 bp, synthetic construct
  source 1..20: mol_type = other DNA
gtattatttgcatcttatca

SEQ ID NO: 2969 - DNA, 20 bp, synthetic construct
  source 1..20: mol_type = other DNA
agtgagtcttacaaaaagtt

SEQ ID NO: 2970 - DNA, 20 bp, synthetic construct
  source 1..20: mol_type = other DNA
gagaaaagcacagatgactc

SEQ ID NO: 2971 - DNA, 20 bp, synthetic construct
  source 1..20: mol_type = other DNA
ctctgcaattcaaaaaaagt

SEQ ID NO: 2972 - DNA, 20 bp, synthetic construct
  source 1..20: mol_type = other DNA
taggcaatgagagatgatac

SEQ ID NO: 2973 - DNA, 20 bp, synthetic construct
  source 1..20: mol_type = other DNA
cagctgaagattctctctct

SEQ ID NO: 2974 - DNA, 20 bp, synthetic construct
  source 1..20: mol_type = other DNA
tcaggattgggaactaagaa

SEQ ID NO: 2975 - DNA, 20 bp, synthetic construct
  source 1..20: mol_type = other DNA
ttctctaaactttagtctct

SEQ ID NO: 2976 - DNA, 20 bp, synthetic construct
  source 1..20: mol_type = other DNA
tactctttcaactgttcttt

SEQ ID NO: 2977 - DNA, 20 bp, synthetic construct
  source 1..20: mol_type = other DNA
ggatggtgaaaattatagga

SEQ ID NO: 2978 - DNA, 20 bp, synthetic construct
  source 1..20: mol_type = other DNA
ttctatattgcagagccacc

SEQ ID NO: 2979 - DNA, 20 bp, synthetic construct
  source 1..20: mol_type = other DNA
ttcagtggagtttagttcag

SEQ ID NO: 2980 - DNA, 20 bp, synthetic construct
  source 1..20: mol_type = other DNA
ccaagttcacaaaaccaata

SEQ ID NO: 2981 - DNA, 20 bp, synthetic construct
  source 1..20: mol_type = other DNA
atggcaaactcctacttggc

SEQ ID NO: 2982 - DNA, 20 bp, synthetic construct
  source 1..20: mol_type = other DNA
ttttcccagaaccagtgaat

SEQ ID NO: 2983 - DNA, 20 bp, synthetic construct
  source 1..20: mol_type = other DNA
tttggatatggtaaggtaca

SEQ ID NO: 2984 - DNA, 20 bp, synthetic construct
  source 1..20: mol_type = other DNA
tgctgcacactcgcgactct

SEQ ID NO: 2985 - DNA, 20 bp, synthetic construct
  source 1..20: mol_type = other DNA
tcgctagggaatgtaaacaa

SEQ ID NO: 2986 - DNA, 20 bp, synthetic construct
  source 1..20: mol_type = other DNA
ctttcatagcttccaccaca

SEQ ID NO: 2987 - DNA, 20 bp, synthetic construct
  source 1..20: mol_type = other DNA
gcattaactccaaaacattc

SEQ ID NO: 2988 - DNA, 20 bp, synthetic construct
  source 1..20: mol_type = other DNA
acagccactttcagccactt

SEQ ID NO: 2989 - DNA, 20 bp, synthetic construct
  source 1..20: mol_type = other DNA
cattcttctttgtaatcaag

SEQ ID NO: 2990 - DNA, 20 bp, synthetic construct
  source 1..20: mol_type = other DNA
gctagtgtagatgctatatt

SEQ ID NO: 2991 - DNA, 20 bp, synthetic construct
  source 1..20: mol_type = other DNA
gtcaaactcttcagagtttc

SEQ ID NO: 2992 - DNA, 20 bp, synthetic construct
  source 1..20: mol_type = other DNA
ggaaaatttgttctgagata

SEQ ID NO: 2993 - DNA, 20 bp, synthetic construct
  source 1..20: mol_type = other DNA
atccagagatgtcagatttt

SEQ ID NO: 2994 - DNA, 20 bp, synthetic construct
  source 1..20: mol_type = other DNA
gcgcgagcctttatattgaa

SEQ ID NO: 2995 - DNA, 20 bp, synthetic construct
  source 1..20: mol_type = other DNA
catttcatatagtcggatga

SEQ ID NO: 2996 - DNA, 20 bp, synthetic construct
  source 1..20: mol_type = other DNA
ttgatgttcttcaccatcat

SEQ ID NO: 2997 - DNA, 20 bp, synthetic construct
  source 1..20: mol_type = other DNA
tgctgaagcaggcgatccaa

SEQ ID NO: 2998 - DNA, 20 bp, synthetic construct
  source 1..20: mol_type = other DNA
tcaagaaatgagagctgtcc

SEQ ID NO: 2999 - DNA, 20 bp, synthetic construct
  source 1..20: mol_type = other DNA
tcctccagttcctatccaaa

SEQ ID NO: 3000 - DNA, 20 bp, synthetic construct
  source 1..20: mol_type = other DNA
atgtctaggaaagacacaga

SEQ ID NO: 3001 - DNA, 20 bp, synthetic construct
  source 1..20: mol_type = other DNA
atttaaatatggtattcatt

SEQ ID NO: 3002 - DNA, 20 bp, synthetic construct
  source 1..20: mol_type = other DNA
actcataactactccggaca

SEQ ID NO: 3003 - DNA, 20 bp, synthetic construct
  source 1..20: mol_type = other DNA
tggcagtctggaatatcatg

SEQ ID NO: 3004 - DNA, 20 bp, synthetic construct
  source 1..20: mol_type = other DNA
aatcaaacttctgagtttaa

SEQ ID NO: 3005 - DNA, 20 bp, synthetic construct
  source 1..20: mol_type = other DNA
agcactacttattttccaat

SEQ ID NO: 3006 - DNA, 20 bp, synthetic construct
  source 1..20: mol_type = other DNA
aggcaccttcattcctattg

SEQ ID NO: 3007 - DNA, 20 bp, synthetic construct
  source 1..20: mol_type = other DNA
ttttaattttatgccagagt

SEQ ID NO: 3008 - DNA, 20 bp, synthetic construct
  source 1..20: mol_type = other DNA
ttgtgattttataaacatca

SEQ ID NO: 3009 - DNA, 20 bp, synthetic construct
  source 1..20: mol_type = other DNA
ttaacccttatttatatatg

SEQ ID NO: 3010 - DNA, 20 bp, synthetic construct
  source 1..20: mol_type = other DNA
ttatatacatctgtgtataa

SEQ ID NO: 3011 - DNA, 20 bp, synthetic construct
  source 1..20: mol_type = other DNA
ttaacatataacactattta

SEQ ID NO: 3012 - DNA, 20 bp, synthetic construct
  source 1..20: mol_type = other DNA
cagaggatacccattgcaaa

SEQ ID NO: 3013 - DNA, 20 bp, synthetic construct
  source 1..20: mol_type = other DNA
cctctttaactgcacagtag

SEQ ID NO: 3014 - DNA, 20 bp, synthetic construct
  source 1..20: mol_type = other DNA
aacctttcccaaagtggcta

SEQ ID NO: 3015 - DNA, 20 bp, synthetic construct
  source 1..20: mol_type = other DNA
taaccctacttcttacaagt

SEQ ID NO: 3016 - DNA, 20 bp, synthetic construct
  source 1..20: mol_type = other DNA
catcgatattctcaaagcct

SEQ ID NO: 3017 - DNA, 20 bp, synthetic construct
  source 1..20: mol_type = other DNA
tacttaaaatacttcaaaca

SEQ ID NO: 3018 - DNA, 20 bp, synthetic construct
  source 1..20: mol_type = other DNA
accatatactatgagaccag

SEQ ID NO: 3019 - DNA, 20 bp, synthetic construct
  source 1..20: mol_type = other DNA
ggaattacagtggagaggtt

SEQ ID NO: 3020 - DNA, 20 bp, synthetic construct
  source 1..20: mol_type = other DNA
gtgcatagtctgtaggtagt

SEQ ID NO: 3021 - DNA, 20 bp, synthetic construct
  source 1..20: mol_type = other DNA
gctctgttgtcacccttgta

SEQ ID NO: 3022 - DNA, 20 bp, synthetic construct
  source 1..20: mol_type = other DNA
cattagaagatgaattcact

SEQ ID NO: 3023 - DNA, 20 bp, synthetic construct
  source 1..20: mol_type = other DNA
ataatattgaacagtaggtt

SEQ ID NO: 3024 - DNA, 20 bp, synthetic construct
  source 1..20: mol_type = other DNA
ctgttgggtagaaagatttg

SEQ ID NO: 3025 - DNA, 20 bp, synthetic construct
  source 1..20: mol_type = other DNA
ggttggaaggcaccaattaa

SEQ ID NO: 3026 - DNA, 20 bp, synthetic construct
  source 1..20: mol_type = other DNA
agcctactgagcggttggaa

SEQ ID NO: 3027 - DNA, 20 bp, synthetic construct
  source 1..20: mol_type = other DNA
gttgcagacattttacatac

SEQ ID NO: 3028 - DNA, 20 bp, synthetic construct
  source 1..20: mol_type = other DNA
tagaaccatacctaaatagt

SEQ ID NO: 3029 - DNA, 20 bp, synthetic construct
  source 1..20: mol_type = other DNA
gtaatacccgaaagaaggga

SEQ ID NO: 3030 - DNA, 20 bp, synthetic construct
  source 1..20: mol_type = other DNA
tgaaaaagctatatccatat

SEQ ID NO: 3031 - DNA, 20 bp, synthetic construct
  source 1..20: mol_type = other DNA
aaaaaaaactttcagtaatc

SEQ ID NO: 3032 - DNA, 20 bp, synthetic construct
  source 1..20: mol_type = other DNA
aacacaatccacaacagaat

SEQ ID NO: 3033 - DNA, 20 bp, synthetic construct
  source 1..20: mol_type = other DNA
aggaggaaaatactatccaa

SEQ ID NO: 3034 - DNA, 20 bp, synthetic construct
  source 1..20: mol_type = other DNA
tatatgcacagttttgctga

SEQ ID NO: 3035 - DNA, 20 bp, synthetic construct
  source 1..20: mol_type = other DNA
agaacagaaagctcagtttt

SEQ ID NO: 3036 - DNA, 20 bp, synthetic construct
  source 1..20: mol_type = other DNA
ctctcagaaacattttctca

SEQ ID NO: 3037 - DNA, 20 bp, synthetic construct
  source 1..20: mol_type = other DNA
aacaaaacttaaaagtgtct

SEQ ID NO: 3038 - DNA, 20 bp, synthetic construct
  source 1..20: mol_type = other DNA
aaacaactcacacatttcta

SEQ ID NO: 3039 - DNA, 20 bp, synthetic construct
  source 1..20: mol_type = other DNA
agttgagttacctcctgata

SEQ ID NO: 3040 - DNA, 20 bp, synthetic construct
  source 1..20: mol_type = other DNA
tctggttactagaatgtagc

SEQ ID NO: 3041 - DNA, 20 bp, synthetic construct
  source 1..20: mol_type = other DNA
gattgcctactccaaggttt

SEQ ID NO: 3042 - DNA, 20 bp, synthetic construct
  source 1..20: mol_type = other DNA
aggcttttaatgaatatttc

SEQ ID NO: 3043 - DNA, 20 bp, synthetic construct
  source 1..20: mol_type = other DNA
ggtattgagagagcttcaga

SEQ ID NO: 3044 - DNA, 20 bp, synthetic construct
  source 1..20: mol_type = other DNA
gaaaagacaaactaggattg

SEQ ID NO: 3045 - DNA, 20 bp, synthetic construct
  source 1..20: mol_type = other DNA
gtagaacagagtctgaagta

SEQ ID NO: 3046 - DNA, 20 bp, synthetic construct
  source 1..20: mol_type = other DNA
ctgtaactctgttgaaatgt

SEQ ID NO: 3047 - DNA, 20 bp, synthetic construct
  source 1..20: mol_type = other DNA
tcaaagaccacagcctttcc

SEQ ID NO: 3048 - DNA, 20 bp, synthetic construct
  source 1..20: mol_type = other DNA
gctaagagacttctttcttc

SEQ ID NO: 3049 - DNA, 20 bp, synthetic construct
  source 1..20: mol_type = other DNA
actaaagtttttgctgttac

SEQ ID NO: 3050 - DNA, 20 bp, synthetic construct
  source 1..20: mol_type = other DNA
cggaaaagacaagaagataa

SEQ ID NO: 3051 - DNA, 20 bp, synthetic construct
  source 1..20: mol_type = other DNA
ttatcatgtgaattagcata

SEQ ID NO: 3052 - DNA, 20 bp, synthetic construct
  source 1..20: mol_type = other DNA
ccagacattgcaaagaaaaa

SEQ ID NO: 3053 - DNA, 20 bp, synthetic construct
  source 1..20: mol_type = other DNA
agtgtgaaggcaccgtaaga

SEQ ID NO: 3054 - DNA, 20 bp, synthetic construct
  source 1..20: mol_type = other DNA
ccaattccatccattgaaat

SEQ ID NO: 3055 - DNA, 20 bp, synthetic construct
  source 1..20: mol_type = other DNA
aaaagtgattaggttgagtg

SEQ ID NO: 3056 - DNA, 20 bp, synthetic construct
  source 1..20: mol_type = other DNA
tattttctacatacccctcg

SEQ ID NO: 3057 - DNA, 20 bp, synthetic construct
  source 1..20: mol_type = other DNA
atctaaaatgttctcaagag

SEQ ID NO: 3058 - DNA, 20 bp, synthetic construct
  source 1..20: mol_type = other DNA
gttggcttctcagaggtttt

SEQ ID NO: 3059 - DNA, 20 bp, synthetic construct
  source 1..20: mol_type = other DNA
gaggacttccacattattgc

SEQ ID NO: 3060 - DNA, 20 bp, synthetic construct
  source 1..20: mol_type = other DNA
tctcattcttttcctctaaa

SEQ ID NO: 3061 - DNA, 20 bp, synthetic construct
  source 1..20: mol_type = other DNA
caggagaatgtatatgcttc

SEQ ID NO: 3062 - DNA, 20 bp, synthetic construct
  source 1..20: mol_type = other DNA
cgtttcataactgttagtat

SEQ ID NO: 3063 - DNA, 20 bp, synthetic construct
  source 1..20: mol_type = other DNA
catccatagctacttttgca

SEQ ID NO: 3064 - DNA, 20 bp, synthetic construct
  source 1..20: mol_type = other DNA
attctcctacactaattgaa

SEQ ID NO: 3065 - DNA, 20 bp, synthetic construct
  source 1..20: mol_type = other DNA
gtccaaatgtgtcaaactct

SEQ ID NO: 3066 - DNA, 20 bp, synthetic construct
  source 1..20: mol_type = other DNA
atctgattatggctaaataa

SEQ ID NO: 3067 - DNA, 20 bp, synthetic construct
  source 1..20: mol_type = other DNA
tggctttacatcctatatgt

SEQ ID NO: 3068 - DNA, 20 bp, synthetic construct
  source 1..20: mol_type = other DNA
aagttctacatagcagtctg

SEQ ID NO: 3069 - DNA, 20 bp, synthetic construct
  source 1..20: mol_type = other DNA
gtgacatgtagttctttgga

SEQ ID NO: 3070 - DNA, 20 bp, synthetic construct
  source 1..20: mol_type = other DNA
aaataaggcatttcatatag

SEQ ID NO: 3071 - DNA, 20 bp, synthetic construct
  source 1..20: mol_type = other DNA
tggtgagccttggttgatct

SEQ ID NO: 3072 - DNA, 20 bp, synthetic construct
  source 1..20: mol_type = other DNA
tagtcagcaatctttgcaat

SEQ ID NO: 3073 - DNA, 20 bp, synthetic construct
  source 1..20: mol_type = other DNA
atgaccaggagagtaccaga

SEQ ID NO: 3074 - DNA, 20 bp, synthetic construct
  source 1..20: mol_type = other DNA
ttttccggttgtagcccaat

SEQ ID NO: 3075 - DNA, 20 bp, synthetic construct
  source 1..20: mol_type = other DNA
tgtaggatctgcagcatcac

SEQ ID NO: 3076 - DNA, 20 bp, synthetic construct
  source 1..20: mol_type = other DNA
acaatgcctttacctgctgc

SEQ ID NO: 3077 - DNA, 20 bp, synthetic construct
  source 1..20: mol_type = other DNA
tacttcagcccaggattgca

SEQ ID NO: 3078 - DNA, 20 bp, synthetic construct
  source 1..20: mol_type = other DNA
ctacatggaacttctgtgat

SEQ ID NO: 3079 - DNA, 20 bp, synthetic construct
  source 1..20: mol_type = other DNA
cagatgtgctgaaagttaat

SEQ ID NO: 3080 - DNA, 20 bp, synthetic construct
  source 1..20: mol_type = other DNA
atgagatttttgagaggcaa

SEQ ID NO: 3081 - DNA, 20 bp, synthetic construct
  source 1..20: mol_type = other DNA
aatttttacatgaagactgt

SEQ ID NO: 3082 - DNA, 20 bp, synthetic construct
  source 1..20: mol_type = other DNA
ctagagaaaactgacagtga

SEQ ID NO: 3083 - DNA, 20 bp, synthetic construct
  source 1..20: mol_type = other DNA
aaagactctaccagaaaaag

SEQ ID NO: 3084 - DNA, 20 bp, synthetic construct
  source 1..20: mol_type = other DNA
aatgtatggtgacttgacct

SEQ ID NO: 3085 - DNA, 20 bp, synthetic construct
  source 1..20: mol_type = other DNA
aacaaaaccacttcttcttc

SEQ ID NO: 3086 - DNA, 20 bp, synthetic construct
  source 1..20: mol_type = other DNA
tgaagagaaaaccacacact

SEQ ID NO: 3087 - DNA, 20 bp, synthetic construct
  source 1..20: mol_type = other DNA
ttatagttcattttttaaga

SEQ ID NO: 3088 - DNA, 20 bp, synthetic construct
  source 1..20: mol_type = other DNA
actccaaagacaatacaaaa

SEQ ID NO: 3089 - DNA, 20 bp, synthetic construct
  source 1..20: mol_type = other DNA
caactggccaattttcctct

SEQ ID NO: 3090 - DNA, 20 bp, synthetic construct
  source 1..20: mol_type = other DNA
gatacattccttcttttcca

SEQ ID NO: 3091 - DNA, 20 bp, synthetic construct
  source 1..20: mol_type = other DNA
ccttttctttgggcctcagc

SEQ ID NO: 3092 - DNA, 20 bp, synthetic construct
  source 1..20: mol_type = other DNA
acttctgaggctgcctatta

SEQ ID NO: 3093 - DNA, 20 bp, synthetic construct
  source 1..20: mol_type = other DNA
ccaattcatcttatgcaaaa

SEQ ID NO: 3094 - DNA, 20 bp, synthetic construct
  source 1..20: mol_type = other DNA
atttcctgagccacccttct

SEQ ID NO: 3095 - DNA, 20 bp, synthetic construct
  source 1..20: mol_type = other DNA
attaagtacttgtccagggt

SEQ ID NO: 3096 - DNA, 20 bp, synthetic construct
  source 1..20: mol_type = other DNA
gacacagagagctgtgagca

SEQ ID NO: 3097 - DNA, 20 bp, synthetic construct
  source 1..20: mol_type = other DNA
gaataaccatgctgacttta

SEQ ID NO: 3098 - DNA, 20 bp, synthetic construct
  source 1..20: mol_type = other DNA
aagacacaaacaattgcaat

SEQ ID NO: 3099 - DNA, 20 bp, synthetic construct
  source 1..20: mol_type = other DNA
tgatagaagtgtttggtttt

SEQ ID NO: 3100 - DNA, 20 bp, synthetic construct
  source 1..20: mol_type = other DNA
ggttagcatgtgaggtgcca

SEQ ID NO: 3101 - DNA, 20 bp, synthetic construct
  source 1..20: mol_type = other DNA
aaggttacaaccatgaacaa

SEQ ID NO: 3102 - DNA, 20 bp, synthetic construct
  source 1..20: mol_type = other DNA
atattgcataacttaatagc

SEQ ID NO: 3103 - DNA, 20 bp, synthetic construct
  source 1..20: mol_type = other DNA
agagcatttttcaacaccta

SEQ ID NO: 3104 - DNA, 20 bp, synthetic construct
  source 1..20: mol_type = other DNA
atagtccagcaggaaaaagc

SEQ ID NO: 3105 - DNA, 20 bp, synthetic construct
  source 1..20: mol_type = other DNA
tgaataattggaggaaattc

SEQ ID NO: 3106 - DNA, 20 bp, synthetic construct
  source 1..20: mol_type = other DNA
ctctgtctccagatataaaa

SEQ ID NO: 3107 - DNA, 20 bp, synthetic construct
  source 1..20: mol_type = other DNA
aattagttgtaaaaatgtaa

SEQ ID NO: 3108 - DNA, 20 bp, synthetic construct
  source 1..20: mol_type = other DNA
caggacactcctagaagctg

SEQ ID NO: 3109 - DNA, 20 bp, synthetic construct
  source 1..20: mol_type = other DNA
tgctatatgaaatacagtgt

SEQ ID NO: 3110 - DNA, 20 bp, synthetic construct
  source 1..20: mol_type = other DNA
gaccatgtttagagaactat

SEQ ID NO: 3111 - DNA, 20 bp, synthetic construct
  source 1..20: mol_type = other DNA
ttacatgacattaccatcta

SEQ ID NO: 3112 - DNA, 20 bp, synthetic construct
  source 1..20: mol_type = other DNA
cagaatttctgcttaaattc

SEQ ID NO: 3113 - DNA, 20 bp, synthetic construct
  source 1..20: mol_type = other DNA
gaaacatggaatctagaaca

SEQ ID NO: 3114 - DNA, 20 bp, synthetic construct
  source 1..20: mol_type = other DNA
caaattaacttaatttttac

SEQ ID NO: 3115 - DNA, 20 bp, synthetic construct
  source 1..20: mol_type = other DNA
gcccaaggacttgtcttacc

SEQ ID NO: 3116 - DNA, 20 bp, synthetic construct
  source 1..20: mol_type = other DNA
gtatcaaaacataccttcct

SEQ ID NO: 3117 - DNA, 20 bp, synthetic construct
  source 1..20: mol_type = other DNA
ttctcaccacataaatattt

SEQ ID NO: 3118 - DNA, 20 bp, synthetic construct
  source 1..20: mol_type = other DNA
ccttgaaatgtagtcacttg

SEQ ID NO: 3119 - DNA, 20 bp, synthetic construct
  source 1..20: mol_type = other DNA
acagaaggcgaagtcaggag

SEQ ID NO: 3120 - DNA, 20 bp, synthetic construct
  source 1..20: mol_type = other DNA
ggccacagtgatcagtttgg

SEQ ID NO: 3121 - DNA, 20 bp, synthetic construct
  source 1..20: mol_type = other DNA
aaaaaatacatatcatcccc

SEQ ID NO: 3122 - DNA, 20 bp, synthetic construct
  source 1..20: mol_type = other DNA
ataatcctttataataagta

SEQ ID NO: 3123 - DNA, 20 bp, synthetic construct
  source 1..20: mol_type = other DNA
cacaagacttaatggagtta

SEQ ID NO: 3124 - DNA, 20 bp, synthetic construct
  source 1..20: mol_type = other DNA
aacaaatgccaacccctaaa

SEQ ID NO: 3125 - DNA, 20 bp, synthetic construct
  source 1..20: mol_type = other DNA
tatagtatttatatgggtgt

SEQ ID NO: 3126 - DNA, 20 bp, synthetic construct
  source 1..20: mol_type = other DNA
acaaagggaaatggttaaac

SEQ ID NO: 3127 - DNA, 20 bp, synthetic construct
  source 1..20: mol_type = other DNA
acgggcaccctacaagaaat

SEQ ID NO: 3128 - DNA, 20 bp, synthetic construct
  source 1..20: mol_type = other DNA
agtaactttccaaatggtat

SEQ ID NO: 3129 - DNA, 20 bp, synthetic construct
  source 1..20: mol_type = other DNA
ctctgccccttttcccagac

SEQ ID NO: 3130 - DNA, 20 bp, synthetic construct
  source 1..20: mol_type = other DNA
ttaccaggtgctggtcatta

SEQ ID NO: 3131 - DNA, 20 bp, synthetic construct
  source 1..20: mol_type = other DNA
ataaagaaaaattacgaaca

SEQ ID NO: 3132 - DNA, 20 bp, synthetic construct
  source 1..20: mol_type = other DNA
tttaccattacctccctaga

SEQ ID NO: 3133 - DNA, 20 bp, synthetic construct
  source 1..20: mol_type = other DNA
cagcttaacctttctataaa

SEQ ID NO: 3134 - DNA, 20 bp, synthetic construct
  source 1..20: mol_type = other DNA
tgattttacctgaagttagg

SEQ ID NO: 3135 - DNA, 20 bp, synthetic construct
  source 1..20: mol_type = other DNA
tcatgaggacttccacatta

SEQ ID NO: 3136 - DNA, 20 bp, synthetic construct
  source 1..20: mol_type = other DNA
gattatttagtgcccagcat

SEQ ID NO: 3137 - DNA, 20 bp, synthetic construct
  source 1..20: mol_type = other DNA
acttcaggagaatgtatatg

SEQ ID NO: 3138 - DNA, 20 bp, synthetic construct
  source 1..20: mol_type = other DNA
atgaaattctgtatcctccc

SEQ ID NO: 3139 - DNA, 20 bp, synthetic construct
  source 1..20: mol_type = other DNA
gcatctgctcccaatagaag

SEQ ID NO: 3140 - DNA, 20 bp, synthetic construct
  source 1..20: mol_type = other DNA
ctgtaatacggcatctcggt

SEQ ID NO: 3141 - DNA, 20 bp, synthetic construct
  source 1..20: mol_type = other DNA
gtgcaagtccaaatgtgtca

SEQ ID NO: 3142 - DNA, 20 bp, synthetic construct
  source 1..20: mol_type = other DNA
atgctgatctgattatggct

SEQ ID NO: 3143 - DNA, 20 bp, synthetic construct
  source 1..20: mol_type = other DNA
tggcacatttttacgctccg

SEQ ID NO: 3144 - DNA, 20 bp, synthetic construct
  source 1..20: mol_type = other DNA
atactgtgacatgtagttct

SEQ ID NO: 3145 - DNA, 20 bp, synthetic construct
  source 1..20: mol_type = other DNA
agaatacagccttttctaca

SEQ ID NO: 3146 - DNA, 20 bp, synthetic construct
  source 1..20: mol_type = other DNA
tggaatggtgagccttggtt

SEQ ID NO: 3147 - DNA, 20 bp, synthetic construct
  source 1..20: mol_type = other DNA
aatgacatttcctctggcaa

SEQ ID NO: 3148 - DNA, 20 bp, synthetic construct
  source 1..20: mol_type = other DNA
ttgcttggaaaaggaattgc

SEQ ID NO: 3149 - DNA, 20 bp, synthetic construct
  source 1..20: mol_type = other DNA
aataaatatttacaagagga

SEQ ID NO: 3150 - DNA, 20 bp, synthetic construct
  source 1..20: mol_type = other DNA
gctatgtaaacaatttaagt

SEQ ID NO: 3151 - DNA, 20 bp, synthetic construct
  source 1..20: mol_type = other DNA
attgggaagatacttggaat

SEQ ID NO: 3152 - DNA, 20 bp, synthetic construct
  source 1..20: mol_type = other DNA
acacaaatcatttcaaaatg

SEQ ID NO: 3153 - DNA, 20 bp, synthetic construct
  source 1..20: mol_type = other DNA
ggcacaagtttcttactcgc

SEQ ID NO: 3154 - DNA, 20 bp, synthetic construct
  source 1..20: mol_type = other DNA
tctaatttgtctaaatttat

SEQ ID NO: 3155 - DNA, 20 bp, synthetic construct
  source 1..20: mol_type = other DNA
ctctgcacttcagtgtttgt

SEQ ID NO: 3156 - DNA, 20 bp, synthetic construct
  source 1..20: mol_type = other DNA
atctcagttatcaatctcag

SEQ ID NO: 3157 - DNA, 20 bp, synthetic construct
  source 1..20: mol_type = other DNA
ataaccccacacctttactg

SEQ ID NO: 3158 - DNA, 20 bp, synthetic construct
  source 1..20: mol_type = other DNA
cgaggctcaaccccattgga

SEQ ID NO: 3159 - DNA, 20 bp, synthetic construct
  source 1..20: mol_type = other DNA
tatataattgctaggtagag

SEQ ID NO: 3160 - DNA, 20 bp, synthetic construct
  source 1..20: mol_type = other DNA
tcattcagctacttttgaaa

SEQ ID NO: 3161 - DNA, 20 bp, synthetic construct
  source 1..20: mol_type = other DNA
accaacagaatgaggtgtgc

SEQ ID NO: 3162 - DNA, 20 bp, synthetic construct
  source 1..20: mol_type = other DNA
attcaaacaaaatgttagta

SEQ ID NO: 3163 - DNA, 20 bp, synthetic construct
  source 1..20: mol_type = other DNA
actcaatagtcaccttcttt

SEQ ID NO: 3164 - DNA, 20 bp, synthetic construct
  source 1..20: mol_type = other DNA
atgtggaggtatcgaccatt

SEQ ID NO: 3165 - DNA, 20 bp, synthetic construct
  source 1..20: mol_type = other DNA
cgggaattatttcacttcat

SEQ ID NO: 3166 - DNA, 20 bp, synthetic construct
  source 1..20: mol_type = other DNA
ccttgtatctagtctctctc

SEQ ID NO: 3167 - DNA, 20 bp, synthetic construct
  source 1..20: mol_type = other DNA
ctacaagtcaaaaatgtggt

SEQ ID NO: 3168 - DNA, 20 bp, synthetic construct
  source 1..20: mol_type = other DNA
atcatttccattaattattt

SEQ ID NO: 3169 - DNA, 20 bp, synthetic construct
  source 1..20: mol_type = other DNA
cttagaatgaaattgctgat

SEQ ID NO: 3170 - DNA, 20 bp, synthetic construct
  source 1..20: mol_type = other DNA
tgccaatgtggagttaattt

SEQ ID NO: 3171 - DNA, 20 bp, synthetic construct
  source 1..20: mol_type = other DNA
taattattctcagtctttaa

SEQ ID NO: 3172 - DNA, 20 bp, synthetic construct
  source 1..20: mol_type = other DNA
tcttagcacattctctgaac

SEQ ID NO: 3173 - DNA, 20 bp, synthetic construct
  source 1..20: mol_type = other DNA
gacacatttgaaaagttatt

SEQ ID NO: 3174 - DNA, 20 bp, synthetic construct
  source 1..20: mol_type = other DNA
tctttagaatattcacacat

SEQ ID NO: 3175 - DNA, 20 bp, synthetic construct
  source 1..20: mol_type = other DNA
actggcaaatcaaacttcat

SEQ ID NO: 3176 - DNA, 20 bp, synthetic construct
  source 1..20: mol_type = other DNA
aatgtaatctttatcaggac

SEQ ID NO: 3177 - DNA, 20 bp, synthetic construct
  source 1..20: mol_type = other DNA
ttggaaaacagacacaaaag

SEQ ID NO: 3178 - DNA, 20 bp, synthetic construct
  source 1..20: mol_type = other DNA
ggcctttgctggtgaagtct

SEQ ID NO: 3179 - DNA, 20 bp, synthetic construct
  source 1..20: mol_type = other DNA
gaaatccctaccaattgttc

SEQ ID NO: 3180 - DNA, 20 bp, synthetic construct
  source 1..20: mol_type = other DNA
caatcaggctttcttcaagg

SEQ ID NO: 3181 - DNA, 20 bp, synthetic construct
  source 1..20: mol_type = other DNA
tgatgaagtgacagttaaat

SEQ ID NO: 3182 - DNA, 20 bp, synthetic construct
  source 1..20: mol_type = other DNA
gtacaacttagagggcctgg

SEQ ID NO: 3183 - DNA, 20 bp, synthetic construct
  source 1..20: mol_type = other DNA
agttctcaatactctggtat

SEQ ID NO: 3184 - DNA, 20 bp, synthetic construct
  source 1..20: mol_type = other DNA
atttcacatgatgtcagtag

SEQ ID NO: 3185 - DNA, 20 bp, synthetic construct
  source 1..20: mol_type = other DNA
agatagaaaagcaacaaaag

SEQ ID NO: 3186 - DNA, 20 bp, synthetic construct
  source 1..20: mol_type = other DNA
caacaagtctttttaaagat

SEQ ID NO: 3187 - DNA, 20 bp, synthetic construct
  source 1..20: mol_type = other DNA
aacatcagtgattctgatag

SEQ ID NO: 3188 - DNA, 20 bp, synthetic construct
  source 1..20: mol_type = other DNA
ggatctagtaaagcagcatg

SEQ ID NO: 3189 - DNA, 20 bp, synthetic construct
  source 1..20: mol_type = other DNA
tctctttcatatctctttta

SEQ ID NO: 3190 - DNA, 20 bp, synthetic construct
  source 1..20: mol_type = other DNA
gaataggaagacagactgtg

SEQ ID NO: 3191 - DNA, 20 bp, synthetic construct
  source 1..20: mol_type = other DNA
tctttataacagttctatga

SEQ ID NO: 3192 - DNA, 20 bp, synthetic construct
  source 1..20: mol_type = other DNA
gacaactttttgctaataat

SEQ ID NO: 3193 - DNA, 20 bp, synthetic construct
  source 1..20: mol_type = other DNA
ttcaggcctccatacccttg

SEQ ID NO: 3194 - DNA, 20 bp, synthetic construct
  source 1..20: mol_type = other DNA
agagaatccatttgactttg

SEQ ID NO: 3195 - DNA, 20 bp, synthetic construct
  source 1..20: mol_type = other DNA
gaatacaggaataaccactg

SEQ ID NO: 3196 - DNA, 20 bp, synthetic construct
  source 1..20: mol_type = other DNA
aacagtgcacacagtgtagt

SEQ ID NO: 3197 - DNA, 20 bp, synthetic construct
  source 1..20: mol_type = other DNA
ctactgtcaacacagtaatt

SEQ ID NO: 3198 - DNA, 20 bp, synthetic construct
  source 1..20: mol_type = other DNA
cttctctgccccatgatgtc

SEQ ID NO: 3199 - DNA, 20 bp, synthetic construct
  source 1..20: mol_type = other DNA
tttcttctgtgccaggcacg

SEQ ID NO: 3200 - DNA, 20 bp, synthetic construct
  source 1..20: mol_type = other DNA
gccactattaagtggtagag

SEQ ID NO: 3201 - DNA, 20 bp, synthetic construct
  source 1..20: mol_type = other DNA
ccaaggttgaccacacagga

SEQ ID NO: 3202 - DNA, 20 bp, synthetic construct
  source 1..20: mol_type = other DNA
tcataagatttgacagcatg

SEQ ID NO: 3203 - DNA, 20 bp, synthetic construct
  source 1..20: mol_type = other DNA
ttcagaaaccacatttctgc

SEQ ID NO: 3204 - DNA, 20 bp, synthetic construct
  source 1..20: mol_type = other DNA
caatcagcaagtattttcag

SEQ ID NO: 3205 - DNA, 20 bp, synthetic construct
  source 1..20: mol_type = other DNA
gtggtgcttggactgaaata

SEQ ID NO: 3206 - DNA, 20 bp, synthetic construct
  source 1..20: mol_type = other DNA
ttgtactatatctaaatttc

SEQ ID NO: 3207 - DNA, 20 bp, synthetic construct
  source 1..20: mol_type = other DNA
taatctgcttctcttgtggg

SEQ ID NO: 3208 - DNA, 20 bp, synthetic construct
  source 1..20: mol_type = other DNA
atattaaactggcctgaaaa

SEQ ID NO: 3209 - DNA, 20 bp, synthetic construct
  source 1..20: mol_type = other DNA
agcacatgtaaagctttgca

SEQ ID NO: 3210 - DNA, 20 bp, synthetic construct
  source 1..20: mol_type = other DNA
ctcatgaggacttccacatt

SEQ ID NO: 3211 - DNA, 20 bp, synthetic construct
  source 1..20: mol_type = other DNA
agattatttagtgcccagca

SEQ ID NO: 3212 - DNA, 20 bp, synthetic construct
  source 1..20: mol_type = other DNA
cacttcaggagaatgtatat

SEQ ID NO: 3213 - DNA, 20 bp, synthetic construct
  source 1..20: mol_type = other DNA
tttagcttatgatgaaattc

SEQ ID NO: 3214 - DNA, 20 bp, synthetic construct
  source 1..20: mol_type = other DNA
cactattcagtaagagttcc

SEQ ID NO: 3215 - DNA, 20 bp, synthetic construct
  source 1..20: mol_type = other DNA
cgctgtaatacggcatctcg

SEQ ID NO: 3216 - DNA, 20 bp, synthetic construct
  source 1..20: mol_type = other DNA
atgatgtaaatttattactg

SEQ ID NO: 3217 - DNA, 20 bp, synthetic construct
  source 1..20: mol_type = other DNA
gatgctgatctgattatggc

SEQ ID NO: 3218 - DNA, 20 bp, synthetic construct
  source 1..20: mol_type = other DNA
ggccagtctttcacatctat

SEQ ID NO: 3219 - DNA, 20 bp, synthetic construct
  source 1..20: mol_type = other DNA
ttggcacatttttacgctcc

SEQ ID NO: 3220 - DNA, 20 bp, synthetic construct
  source 1..20: mol_type = other DNA
aatactgtgacatgtagttc

SEQ ID NO: 3221 - DNA, 20 bp, synthetic construct
  source 1..20: mol_type = other DNA
ccaaaagaatacagcctttt

SEQ ID NO: 3222 - DNA, 20 bp, synthetic construct
  source 1..20: mol_type = other DNA
gatattggaatggtgagcct

SEQ ID NO: 3223 - DNA, 20 bp, synthetic construct
  source 1..20: mol_type = other DNA
tagtaaaccaaatgaataaa

SEQ ID NO: 3224 - DNA, 20 bp, synthetic construct
  source 1..20: mol_type = other DNA
cctttaagcttaacagtctt

SEQ ID NO: 3225 - DNA, 20 bp, synthetic construct
  source 1..20: mol_type = other DNA
ttactggtaagtatttttac

SEQ ID NO: 3226 - DNA, 20 bp, synthetic construct
  source 1..20: mol_type = other DNA
ggtaagctatgtaaacaatt

SEQ ID NO: 3227 - DNA, 20 bp, synthetic construct
  source 1..20: mol_type = other DNA
aactattcataatcttctca

SEQ ID NO: 3228 - DNA, 20 bp, synthetic construct
  source 1..20: mol_type = other DNA
ttggctgtgcaaaagaagga

SEQ ID NO: 3229 - DNA, 20 bp, synthetic construct
  source 1..20: mol_type = other DNA
ctgctacatgataaggaagc

SEQ ID NO: 3230 - DNA, 20 bp, synthetic construct
  source 1..20: mol_type = other DNA
cacaccctttatgtactgaa

SEQ ID NO: 3231 - DNA, 20 bp, synthetic construct
  source 1..20: mol_type = other DNA
tcttagtggccaaagcaact

SEQ ID NO: 3232 - DNA, 20 bp, synthetic construct
  source 1..20: mol_type = other DNA
tcacaagctctgtgtcctca

SEQ ID NO: 3233 - DNA, 20 bp, synthetic construct
  source 1..20: mol_type = other DNA
tcataaccccacacctttac

SEQ ID NO: 3234 - DNA, 20 bp, synthetic construct
  source 1..20: mol_type = other DNA
ttttttttgatgtggagaaa

SEQ ID NO: 3235 - DNA, 20 bp, synthetic construct
  source 1..20: mol_type = other DNA
gactcatgtaagaagacaag

SEQ ID NO: 3236 - DNA, 20 bp, synthetic construct
  source 1..20: mol_type = other DNA
tttaattttaactatgaaga

SEQ ID NO: 3237 - DNA, 20 bp, synthetic construct
  source 1..20: mol_type = other DNA
taacagtttgaccaactcta

SEQ ID NO: 3238 - DNA, 20 bp, synthetic construct
  source 1..20: mol_type = other DNA
aattcaaacaaaatgttagt

SEQ ID NO: 3239 - DNA, 20 bp, synthetic construct
  source 1..20: mol_type = other DNA
ttactcaatagtcaccttct

SEQ ID NO: 3240 - DNA, 20 bp, synthetic construct
  source 1..20: mol_type = other DNA
ttccaatacttaaaacaagt

SEQ ID NO: 3241 - DNA, 20 bp, synthetic construct
  source 1..20: mol_type = other DNA
aagatagaattcatagtaat

SEQ ID NO: 3242 - DNA, 20 bp, synthetic construct
  source 1..20: mol_type = other DNA
ccatggacctccaacccaat

SEQ ID NO: 3243 - DNA, 20 bp, synthetic construct
  source 1..20: mol_type = other DNA
cactacaagtcaaaaatgtg

SEQ ID NO: 3244 - DNA, 20 bp, synthetic construct
  source 1..20: mol_type = other DNA
atttttaagggagatctctc

SEQ ID NO: 3245 - DNA, 20 bp, synthetic construct
  source 1..20: mol_type = other DNA
ttcatgtctaataatcttta

SEQ ID NO: 3246 - DNA, 20 bp, synthetic construct
  source 1..20: mol_type = other DNA
tctaaagaaattcagacaac

SEQ ID NO: 3247 - DNA, 20 bp, synthetic construct
  source 1..20: mol_type = other DNA
caaagaaaaaagtccaataa

SEQ ID NO: 3248 - DNA, 20 bp, synthetic construct
  source 1..20: mol_type = other DNA
gcaacctgcaataaaaccca

SEQ ID NO: 3249 - DNA, 20 bp, synthetic construct
  source 1..20: mol_type = other DNA
agactaagttgtagagatgc

SEQ ID NO: 3250 - DNA, 20 bp, synthetic construct
  source 1..20: mol_type = other DNA
taaaataaataaatgccagc

SEQ ID NO: 3251 - DNA, 20 bp, synthetic construct
  source 1..20: mol_type = other DNA
actaaaagactagtgactta

SEQ ID NO: 3252 - DNA, 20 bp, synthetic construct
  source 1..20: mol_type = other DNA
gaacccatttctggagggtt

SEQ ID NO: 3253 - DNA, 20 bp, synthetic construct
  source 1..20: mol_type = other DNA
cactagaacagctaaaagta

SEQ ID NO: 3254 - DNA, 20 bp, synthetic construct
  source 1..20: mol_type = other DNA
tcactaacaggataattaaa

SEQ ID NO: 3255 - DNA, 20 bp, synthetic construct
  source 1..20: mol_type = other DNA
tgaagtgtactgtaagtata

SEQ ID NO: 3256 - DNA, 20 bp, synthetic construct
  source 1..20: mol_type = other DNA
cttgaaagttacaaggataa

SEQ ID NO: 3257 - DNA, 20 bp, synthetic construct
  source 1..20: mol_type = other DNA
ggtgggtaggttggctggag

SEQ ID NO: 3258 - DNA, 20 bp, synthetic construct
  source 1..20: mol_type = other DNA
actgaaatgccacttttaaa

SEQ ID NO: 3259 - DNA, 20 bp, synthetic construct
  source 1..20: mol_type = other DNA
atgggtgttatttaataaaa

SEQ ID NO: 3260 - DNA, 20 bp, synthetic construct
  source 1..20: mol_type = other DNA
aagtgtaaagaccagaaaca

SEQ ID NO: 3261 - DNA, 20 bp, synthetic construct
  source 1..20: mol_type = other DNA
tagtctccattctaaaaagc

SEQ ID NO: 3262 - DNA, 20 bp, synthetic construct
  source 1..20: mol_type = other DNA
gacttattggtaatgatatc

SEQ ID NO: 3263 - DNA, 20 bp, synthetic construct
  source 1..20: mol_type = other DNA
gcagagacataaaatcccac

SEQ ID NO: 3264 - DNA, 20 bp, synthetic construct
  source 1..20: mol_type = other DNA
ttccatgtgaaatataagaa

SEQ ID NO: 3265 - DNA, 20 bp, synthetic construct
  source 1..20: mol_type = other DNA
aaggttaaattgccatgtaa

SEQ ID NO: 3266 - DNA, 20 bp, synthetic construct
  source 1..20: mol_type = other DNA
ctaggagaggacttccatga

SEQ ID NO: 3267 - DNA, 20 bp, synthetic construct
  source 1..20: mol_type = other DNA
attatatggcagacatgttg

SEQ ID NO: 3268 - DNA, 20 bp, synthetic construct
  source 1..20: mol_type = other DNA
ttggacaactttttgctaat

SEQ ID NO: 3269 - DNA, 20 bp, synthetic construct
  source 1..20: mol_type = other DNA
accttcaggcctccataccc

SEQ ID NO: 3270 - DNA, 20 bp, synthetic construct
  source 1..20: mol_type = other DNA
cctttatttttataaattga

SEQ ID NO: 3271 - DNA, 20 bp, synthetic construct
  source 1..20: mol_type = other DNA
tacagttgagttctggtata

SEQ ID NO: 3272 - DNA, 20 bp, synthetic construct
  source 1..20: mol_type = other DNA
gaaacagtgcacacagtgta

SEQ ID NO: 3273 - DNA, 20 bp, synthetic construct
  source 1..20: mol_type = other DNA
aaaaactagaacctagagtt

SEQ ID NO: 3274 - DNA, 20 bp, synthetic construct
  source 1..20: mol_type = other DNA
agatgtctataaaattctga

SEQ ID NO: 3275 - DNA, 20 bp, synthetic construct
  source 1..20: mol_type = other DNA
aaccaggcattggaatctgg

SEQ ID NO: 3276 - DNA, 20 bp, synthetic construct
  source 1..20: mol_type = other DNA
aatttcttgatgaacatcat

SEQ ID NO: 3277 - DNA, 20 bp, synthetic construct
  source 1..20: mol_type = other DNA
ctaaaccaggctgtgttatt

SEQ ID NO: 3278 - DNA, 20 bp, synthetic construct
  source 1..20: mol_type = other DNA
ttttcataagatttgacagc

SEQ ID NO: 3279 - DNA, 20 bp, synthetic construct
  source 1..20: mol_type = other DNA
tttaacctcagaactaatgt

SEQ ID NO: 3280 - DNA, 20 bp, synthetic construct
  source 1..20: mol_type = other DNA
atcagatgtcatttatcatt

SEQ ID NO: 3281 - DNA, 20 bp, synthetic construct
  source 1..20: mol_type = other DNA
agcacaaagtcacctaacct

SEQ ID NO: 3282 - DNA, 20 bp, synthetic construct
  source 1..20: mol_type = other DNA
tctatgtggctctttgtaga

SEQ ID NO: 3283 - DNA, 20 bp, synthetic construct
  source 1..20: mol_type = other DNA
agctgcagtaatctgcttct

SEQ ID NO: 3284 - DNA, 20 bp, synthetic construct
  source 1..20: mol_type = other DNA
atatattaaactggcctgaa

SEQ ID NO: 3285 - DNA, 20 bp, synthetic construct
  source 1..20: mol_type = other DNA
caaacagcacatgtaaagct

SEQ ID NO: 3286 - DNA, 20 bp, synthetic construct
  source 1..20: mol_type = other DNA
actcatgaggacttccacat

SEQ ID NO: 3287 - DNA, 20 bp, synthetic construct
  source 1..20: mol_type = other DNA
gagattatttagtgcccagc

SEQ ID NO: 3288 - DNA, 20 bp, synthetic construct
  source 1..20: mol_type = other DNA
ccacttcaggagaatgtata

SEQ ID NO: 3289 - DNA, 20 bp, synthetic construct
  source 1..20: mol_type = other DNA
tatttagcttatgatgaaat

SEQ ID NO: 3290 - DNA, 20 bp, synthetic construct
  source 1..20: mol_type = other DNA
agatccactattcagtaaga

SEQ ID NO: 3291 - DNA, 20 bp, synthetic construct
  source 1..20: mol_type = other DNA
acgctgtaatacggcatctc

SEQ ID NO: 3292 - DNA, 20 bp, synthetic construct
  source 1..20: mol_type = other DNA
gattagcaatacaactcatt

SEQ ID NO: 3293 - DNA, 20 bp, synthetic construct
  source 1..20: mol_type = other DNA
agatgctgatctgattatgg

SEQ ID NO: 3294 - DNA, 20 bp, synthetic construct
  source 1..20: mol_type = other DNA
ggataggccagtctttcaca

SEQ ID NO: 3295 - DNA, 20 bp, synthetic construct
  source 1..20: mol_type = other DNA
aattggcacatttttacgct

SEQ ID NO: 3296 - DNA, 20 bp, synthetic construct
  source 1..20: mol_type = other DNA
aaaatactgtgacatgtagt

SEQ ID NO: 3297 - DNA, 20 bp, synthetic construct
  source 1..20: mol_type = other DNA
acaacttggcccaaaagaat

SEQ ID NO: 3298 - DNA, 20 bp, synthetic construct
  source 1..20: mol_type = other DNA
tcagccaaaatcaagtcagg

SEQ ID NO: 3299 - DNA, 20 bp, synthetic construct
  source 1..20: mol_type = other DNA
tagagtagtaaaccaaatga

SEQ ID NO: 3300 - DNA, 20 bp, synthetic construct
  source 1..20: mol_type = other DNA
cagctcctttaagcttaaca

SEQ ID NO: 3301 - DNA, 20 bp, synthetic construct
  source 1..20: mol_type = other DNA
cacatttactggtaagtatt

SEQ ID NO: 3302 - DNA, 20 bp, synthetic construct
  source 1..20: mol_type = other DNA
aattattacataggtatttg

SEQ ID NO: 3303 - DNA, 20 bp, synthetic construct
  source 1..20: mol_type = other DNA
ggtatactacaactaaaggc

SEQ ID NO: 3304 - DNA, 20 bp, synthetic construct
  source 1..20: mol_type = other DNA
caaatattggctgtgcaaaa

SEQ ID NO: 3305 - DNA, 20 bp, synthetic construct
  source 1..20: mol_type = other DNA
taagccagattgtataagaa

SEQ ID NO: 3306 - DNA, 20 bp, synthetic construct
  source 1..20: mol_type = other DNA
acacaccctttatgtactga

SEQ ID NO: 3307 - DNA, 20 bp, synthetic construct
  source 1..20: mol_type = other DNA
ctacctcttagtggccaaag

SEQ ID NO: 3308 - DNA, 20 bp, synthetic construct
  source 1..20: mol_type = other DNA
taattgaactgtactgtcac

SEQ ID NO: 3309 - DNA, 20 bp, synthetic construct
  source 1..20: mol_type = other DNA
cactcataaccccacacctt

SEQ ID NO: 3310 - DNA, 20 bp, synthetic construct
  source 1..20: mol_type = other DNA
tgttatattgcttacctttt

SEQ ID NO: 3311 - DNA, 20 bp, synthetic construct
  source 1..20: mol_type = other DNA
tcaatggctctatttaacac

SEQ ID NO: 3312 - DNA, 20 bp, synthetic construct
  source 1..20: mol_type = other DNA
gttttaattttaactatgaa

SEQ ID NO: 3313 - DNA, 20 bp, synthetic construct
  source 1..20: mol_type = other DNA
cattatatatattatctact

SEQ ID NO: 3314 - DNA, 20 bp, synthetic construct
  source 1..20: mol_type = other DNA
aaattcaaacaaaatgttag

SEQ ID NO: 3315 - DNA, 20 bp, synthetic construct
  source 1..20: mol_type = other DNA
cttactcaatagtcaccttc

SEQ ID NO: 3316 - DNA, 20 bp, synthetic construct
  source 1..20: mol_type = other DNA
acacatgtcatttccaattt

SEQ ID NO: 3317 - DNA, 20 bp, synthetic construct
  source 1..20: mol_type = other DNA
taattgtctaaactttgaac

SEQ ID NO: 3318 - DNA, 20 bp, synthetic construct
  source 1..20: mol_type = other DNA
tcacatcaaacagatctccc

SEQ ID NO: 3319 - DNA, 20 bp, synthetic construct
  source 1..20: mol_type = other DNA
tgtagctgaactatgctaaa

SEQ ID NO: 3320 - DNA, 20 bp, synthetic construct
  source 1..20: mol_type = other DNA
tgtattaaagtttgagtata

SEQ ID NO: 3321 - DNA, 20 bp, synthetic construct
  source 1..20: mol_type = other DNA
ccacagtgaacattcatgtc

SEQ ID NO: 3322 - DNA, 20 bp, synthetic construct
  source 1..20: mol_type = other DNA
gtccaaatataaaggcaaaa

SEQ ID NO: 3323 - DNA, 20 bp, synthetic construct
  source 1..20: mol_type = other DNA
agaagtggtaagttaaaaag

SEQ ID NO: 3324 - DNA, 20 bp, synthetic construct
  source 1..20: mol_type = other DNA
ccagtatcttgaattcctta

SEQ ID NO: 3325 - DNA, 20 bp, synthetic construct
  source 1..20: mol_type = other DNA
tatcaaaacattagaactat

SEQ ID NO: 3326 - DNA, 20 bp, synthetic construct
  source 1..20: mol_type = other DNA
gagaaagtgaatctgataaa

SEQ ID NO: 3327 - DNA, 20 bp, synthetic construct
  source 1..20: mol_type = other DNA
atctttggcttaaggtccct

SEQ ID NO: 3328 - DNA, 20 bp, synthetic construct
  source 1..20: mol_type = other DNA
tgaagattaaagtaagcagg

SEQ ID NO: 3329 - DNA, 20 bp, synthetic construct
  source 1..20: mol_type = other DNA
aataagaatggccaataaga

SEQ ID NO: 3330 - DNA, 20 bp, synthetic construct
  source 1..20: mol_type = other DNA
caggataattaaatcactaa

SEQ ID NO: 3331 - DNA, 20 bp, synthetic construct
  source 1..20: mol_type = other DNA
tcttgaagtgtactgtaagt

SEQ ID NO: 3332 - DNA, 20 bp, synthetic construct
  source 1..20: mol_type = other DNA
aaatgtcttgaaagttacaa

SEQ ID NO: 3333 - DNA, 20 bp, synthetic construct
  source 1..20: mol_type = other DNA
accgaatgagaattaggtgg

SEQ ID NO: 3334 - DNA, 20 bp, synthetic construct
  source 1..20: mol_type = other DNA
ataattttgtctcttccaga

SEQ ID NO: 3335 - DNA, 20 bp, synthetic construct
  source 1..20: mol_type = other DNA
tatggtactagctcataaag

SEQ ID NO: 3336 - DNA, 20 bp, synthetic construct
  source 1..20: mol_type = other DNA
tatgagaaagtaataagacc

SEQ ID NO: 3337 - DNA, 20 bp, synthetic construct
  source 1..20: mol_type = other DNA
gtttagtctccattctaaaa

SEQ ID NO: 3338 - DNA, 20 bp, synthetic construct
  source 1..20: mol_type = other DNA
aggtgatttataagtgccaa

SEQ ID NO: 3339 - DNA, 20 bp, synthetic construct
  source 1..20: mol_type = other DNA
ggttatttgtaaaatgttat

SEQ ID NO: 3340 - DNA, 20 bp, synthetic construct
  source 1..20: mol_type = other DNA
cattttccatgtgaaatata

SEQ ID NO: 3341 - DNA, 20 bp, synthetic construct
  source 1..20: mol_type = other DNA
aaattcctttgtatttctcc

SEQ ID NO: 3342 - DNA, 20 bp, synthetic construct
  source 1..20: mol_type = other DNA
gtctcatcaataatatattc

SEQ ID NO: 3343 - DNA, 20 bp, synthetic construct
  source 1..20: mol_type = other DNA
tgttattatatggcagacat

SEQ ID NO: 3344 - DNA, 20 bp, synthetic construct
  source 1..20: mol_type = other DNA
ctcaaattttggacaacttt

SEQ ID NO: 3345 - DNA, 20 bp, synthetic construct
  source 1..20: mol_type = other DNA
atgctttgtaccttcaggcc

SEQ ID NO: 3346 - DNA, 20 bp, synthetic construct
  source 1..20: mol_type = other DNA
ttagaaacacttgaagtcat

SEQ ID NO: 3347 - DNA, 20 bp, synthetic construct
  source 1..20: mol_type = other DNA
aattaaaatgcccccaggat

SEQ ID NO: 3348 - DNA, 20 bp, synthetic construct
  source 1..20: mol_type = other DNA
ctctgtttttatcagacatt

SEQ ID NO: 3349 - DNA, 20 bp, synthetic construct
  source 1..20: mol_type = other DNA
gttatttaaagtaaggtttc

SEQ ID NO: 3350 - DNA, 20 bp, synthetic construct
  source 1..20: mol_type = other DNA
ttcatctcaaccaggtctta

SEQ ID NO: 3351 - DNA, 20 bp, synthetic construct
  source 1..20: mol_type = other DNA
agttgcatatggtttaggag

SEQ ID NO: 3352 - DNA, 20 bp, synthetic construct
  source 1..20: mol_type = other DNA
aatatttacttcaatatgga

SEQ ID NO: 3353 - DNA, 20 bp, synthetic construct
  source 1..20: mol_type = other DNA
catccaaggaggcatacact

SEQ ID NO: 3354 - DNA, 20 bp, synthetic construct
  source 1..20: mol_type = other DNA
ttaaaggaaaagttaaccag

SEQ ID NO: 3355 - DNA, 20 bp, synthetic construct
  source 1..20: mol_type = other DNA
gattgttcctctccctctcc

SEQ ID NO: 3356 - DNA, 20 bp, synthetic construct
  source 1..20: mol_type = other DNA
taatgactaaataggaatct

SEQ ID NO: 3357 - DNA, 20 bp, synthetic construct
  source 1..20: mol_type = other DNA
gtagatttagtggtattgag

SEQ ID NO: 3358 - DNA, 20 bp, synthetic construct
  source 1..20: mol_type = other DNA
actttatattaatttcttgt

SEQ ID NO: 3359 - DNA, 20 bp, synthetic construct
  source 1..20: mol_type = other DNA
taccatgtatttcccatttt

SEQ ID NO: 3360 - DNA, 20 bp, synthetic construct
  source 1..20: mol_type = other DNA
ttctgttaaaactatatatt

SEQ ID NO: 3361 - DNA, 20 bp, synthetic construct
  source 1..20: mol_type = other DNA
acttaacaatatcatataat

SEQ ID NO: 3362 - DNA, 20 bp, synthetic construct
  source 1..20: mol_type = other DNA
attgccactcatgaggactt

SEQ ID NO: 3363 - DNA, 20 bp, synthetic construct
  source 1..20: mol_type = other DNA
cataaggagattatttagtg

SEQ ID NO: 3364 - DNA, 20 bp, synthetic construct
  source 1..20: mol_type = other DNA
ttcagccacttcaggagaat

SEQ ID NO: 3365 - DNA, 20 bp, synthetic construct
  source 1..20: mol_type = other DNA
aaccatatttagcttatgat

SEQ ID NO: 3366 - DNA, 20 bp, synthetic construct
  source 1..20: mol_type = other DNA
tgtcacctttcccaatgctt

SEQ ID NO: 3367 - DNA, 20 bp, synthetic construct
  source 1..20: mol_type = other DNA
gtgaatcatctgaagataat

SEQ ID NO: 3368 - DNA, 20 bp, synthetic construct
  source 1..20: mol_type = other DNA
tctaccacatcagtgaggtt

SEQ ID NO: 3369 - DNA, 20 bp, synthetic construct
  source 1..20: mol_type = other DNA
gtttctctactctagaccat

SEQ ID NO: 3370 - DNA, 20 bp, synthetic construct
  source 1..20: mol_type = other DNA
gtactatagaattcctcacg

SEQ ID NO: 3371 - DNA, 20 bp, synthetic construct
  source 1..20: mol_type = other DNA
aattcaattggcacattttt

SEQ ID NO: 3372 - DNA, 20 bp, synthetic construct
  source 1..20: mol_type = other DNA
gaatttttctaggagcttaa

SEQ ID NO: 3373 - DNA, 20 bp, synthetic construct
  source 1..20: mol_type = other DNA
tggtccacaacttggcccaa

SEQ ID NO: 3374 - DNA, 20 bp, synthetic construct
  source 1..20: mol_type = other DNA
tatttctaggcaggtcagcc

SEQ ID NO: 3375 - DNA, 20 bp, synthetic construct
  source 1..20: mol_type = other DNA
aggcctttcttgaggatttt

SEQ ID NO: 3376 - DNA, 20 bp, synthetic construct
  source 1..20: mol_type = other DNA
gagaaaatctttgtgccaca

SEQ ID NO: 3377 - DNA, 20 bp, synthetic construct
  source 1..20: mol_type = other DNA
acagaatttaaaataaagtt

SEQ ID NO: 3378 - DNA, 20 bp, synthetic construct
  source 1..20: mol_type = other DNA
tatcacagggaattatctga

SEQ ID NO: 3379 - DNA, 20 bp, synthetic construct
  source 1..20: mol_type = other DNA
atcaccttggcctataattt

SEQ ID NO: 3380 - DNA, 20 bp, synthetic construct
  source 1..20: mol_type = other DNA
ttgctttttactagcttgca

SEQ ID NO: 3381 - DNA, 20 bp, synthetic construct
  source 1..20: mol_type = other DNA
ggctctttcacatttcgaaa

SEQ ID NO: 3382 - DNA, 20 bp, synthetic construct
  source 1..20: mol_type = other DNA
tttcctacataaacttttat

SEQ ID NO: 3383 - DNA, 20 bp, synthetic construct
  source 1..20: mol_type = other DNA
gttgagtaccttcttgtttt

SEQ ID NO: 3384 - DNA, 20 bp, synthetic construct
  source 1..20: mol_type = other DNA
tcttgtgtattataattatc

SEQ ID NO: 3385 - DNA, 20 bp, synthetic construct
  source 1..20: mol_type = other DNA
agcaatcattggtagcatac

SEQ ID NO: 3386 - DNA, 20 bp, synthetic construct
  source 1..20: mol_type = other DNA
gtactgaaaatgaaagtctg

SEQ ID NO: 3387 - DNA, 20 bp, synthetic construct
  source 1..20: mol_type = other DNA
aaggtaaggtctcaaccaga

SEQ ID NO: 3388 - DNA, 20 bp, synthetic construct
  source 1..20: mol_type = other DNA
tcattggcatgtttaccatt

SEQ ID NO: 3389 - DNA, 20 bp, synthetic construct
  source 1..20: mol_type = other DNA
ctaacaataaaagttacggt

SEQ ID NO: 3390 - DNA, 20 bp, synthetic construct
  source 1..20: mol_type = other DNA
aatttggttataaaagagta

SEQ ID NO: 3391 - DNA, 20 bp, synthetic construct
  source 1..20: mol_type = other DNA
caggtcttactcaatagtca

SEQ ID NO: 3392 - DNA, 20 bp, synthetic construct
  source 1..20: mol_type = other DNA
agcatcaggttcaaaagcaa

SEQ ID NO: 3393 - DNA, 20 bp, synthetic construct
  source 1..20: mol_type = other DNA
cattgtagttactttgtata

SEQ ID NO: 3394 - DNA, 20 bp, synthetic construct
  source 1..20: mol_type = other DNA
aaactatgaataggacacca

SEQ ID NO: 3395 - DNA, 20 bp, synthetic construct
  source 1..20: mol_type = other DNA
ctggaagatttttatgcaac

SEQ ID NO: 3396 - DNA, 20 bp, synthetic construct
  source 1..20: mol_type = other DNA
ctctcacaatgagacaggat

SEQ ID NO: 3397 - DNA, 20 bp, synthetic construct
  source 1..20: mol_type = other DNA
ggtggagaaataaaaatatc

SEQ ID NO: 3398 - DNA, 20 bp, synthetic construct
  source 1..20: mol_type = other DNA
gatgtcccttgtctatgagt

SEQ ID NO: 3399 - DNA, 20 bp, synthetic construct
  source 1..20: mol_type = other DNA
gtctttgaccaaaatcttct

SEQ ID NO: 3400 - DNA, 20 bp, synthetic construct
  source 1..20: mol_type = other DNA
ctatcttggtttaatcagcc

SEQ ID NO: 3401 - DNA, 20 bp, synthetic construct
  source 1..20: mol_type = other DNA
atatattttcatagactgac

SEQ ID NO: 3402 - DNA, 20 bp, synthetic construct
  source 1..20: mol_type = other DNA
catcttgaaacaggaaaccc

SEQ ID NO: 3403 - DNA, 20 bp, synthetic construct
  source 1..20: mol_type = other DNA
gcttgaaagtataaagaaaa

SEQ ID NO: 3404 - DNA, 20 bp, synthetic construct
  source 1..20: mol_type = other DNA
gctaaataaaggatcttgtt

SEQ ID NO: 3405 - DNA, 20 bp, synthetic construct
  source 1..20: mol_type = other DNA
tcttaagtgggatacaaaaa

SEQ ID NO: 3406 - DNA, 20 bp, synthetic construct
  source 1..20: mol_type = other DNA
aattacaacttcaatatttc

SEQ ID NO: 3407 - DNA, 20 bp, synthetic construct
  source 1..20: mol_type = other DNA
caaagtgaacctgagaataa

SEQ ID NO: 3408 - DNA, 20 bp, synthetic construct
  source 1..20: mol_type = other DNA
tctgtttccattgcctgccc

SEQ ID NO: 3409 - DNA, 20 bp, synthetic construct
  source 1..20: mol_type = other DNA
attattttgcttgctcattt

SEQ ID NO: 3410 - DNA, 20 bp, synthetic construct
  source 1..20: mol_type = other DNA
tatctcagtatcaggatgcc

SEQ ID NO: 3411 - DNA, 20 bp, synthetic construct
  source 1..20: mol_type = other DNA
tacataaacttgcctaatct

SEQ ID NO: 3412 - DNA, 20 bp, synthetic construct
  source 1..20: mol_type = other DNA
atggaaatctggatttatag

SEQ ID NO: 3413 - DNA, 20 bp, synthetic construct
  source 1..20: mol_type = other DNA
tcagaaaacaaaatccttcc

SEQ ID NO: 3414 - DNA, 20 bp, synthetic construct
  source 1..20: mol_type = other DNA
cattaaaaaatacccaaatt

SEQ ID NO: 3415 - DNA, 20 bp, synthetic construct
  source 1..20: mol_type = other DNA
tcaaaccattatgccagaat

SEQ ID NO: 3416 - DNA, 20 bp, synthetic construct
  source 1..20: mol_type = other DNA
aatgtgaaacagacacgcta

SEQ ID NO: 3417 - DNA, 20 bp, synthetic construct
  source 1..20: mol_type = other DNA
aatgtttcaatatgctcttg

SEQ ID NO: 3418 - DNA, 20 bp, synthetic construct
  source 1..20: mol_type = other DNA
attttaagcctccaagtttc

SEQ ID NO: 3419 - DNA, 20 bp, synthetic construct
  source 1..20: mol_type = other DNA
caaaataaatgatacatgtc

SEQ ID NO: 3420 - DNA, 20 bp, synthetic construct
  source 1..20: mol_type = other DNA
catcctaatttttattctca

SEQ ID NO: 3421 - DNA, 20 bp, synthetic construct
  source 1..20: mol_type = other DNA
agccaaaatggcaacagctc

SEQ ID NO: 3422 - DNA, 20 bp, synthetic construct
  source 1..20: mol_type = other DNA
tcattccactttgattgtgt

SEQ ID NO: 3423 - DNA, 20 bp, synthetic construct
  source 1..20: mol_type = other DNA
ggaattttcttcaaattttg

SEQ ID NO: 3424 - DNA, 20 bp, synthetic construct
  source 1..20: mol_type = other DNA
tcataggcacagacagaggt

SEQ ID NO: 3425 - DNA, 20 bp, synthetic construct
  source 1..20: mol_type = other DNA
actacagttgacctatggac

SEQ ID NO: 3426 - DNA, 20 bp, synthetic construct
  source 1..20: mol_type = other DNA
attgcaagcataaacagatt

SEQ ID NO: 3427 - DNA, 20 bp, synthetic construct
  source 1..20: mol_type = other DNA
atgaatattttaactatttc

SEQ ID NO: 3428 - DNA, 20 bp, synthetic construct
  source 1..20: mol_type = other DNA
gctattcatggctctgttgt

SEQ ID NO: 3429 - DNA, 20 bp, synthetic construct
  source 1..20: mol_type = other DNA
gttagaatttggaatcacag

SEQ ID NO: 3430 - DNA, 20 bp, synthetic construct
  source 1..20: mol_type = other DNA
caaatgtggagttctaacag

SEQ ID NO: 3431 - DNA, 20 bp, synthetic construct
  source 1..20: mol_type = other DNA
tggacaaggttacttgggca

SEQ ID NO: 3432 - DNA, 20 bp, synthetic construct
  source 1..20: mol_type = other DNA
tttataaatgtctcagctag

SEQ ID NO: 3433 - DNA, 20 bp, synthetic construct
  source 1..20: mol_type = other DNA
attgctatagccactacgga

SEQ ID NO: 3434 - DNA, 20 bp, synthetic construct
  source 1..20: mol_type = other DNA
ctagaactccaaaagtccta

SEQ ID NO: 3435 - DNA, 20 bp, synthetic construct
  source 1..20: mol_type = other DNA
acaagctagactattgcaat

SEQ ID NO: 3436 - DNA, 20 bp, synthetic construct
  source 1..20: mol_type = other DNA
gaatatattttcttcaccat

SEQ ID NO: 3437 - DNA, 20 bp, synthetic construct
  source 1..20: mol_type = other DNA
aaactaccaattaaaattcc

SEQ ID NO: 3438 - DNA, 20 bp, synthetic construct
  source 1..20: mol_type = other DNA
cacttaacaatatcatataa

SEQ ID NO: 3439 - DNA, 20 bp, synthetic construct
  source 1..20: mol_type = other DNA
cattgccactcatgaggact

SEQ ID NO: 3440 - DNA, 20 bp, synthetic construct
  source 1..20: mol_type = other DNA
tgttttggtacataaggaga

SEQ ID NO: 3441 - DNA, 20 bp, synthetic construct
  source 1..20: mol_type = other DNA
tttcagccacttcaggagaa

SEQ ID NO: 3442 - DNA, 20 bp, synthetic construct
  source 1..20: mol_type = other DNA
taaccatatttagcttatga

SEQ ID NO: 3443 - DNA, 20 bp, synthetic construct
  source 1..20: mol_type = other DNA
ctgtcacctttcccaatgct

SEQ ID NO: 3444 - DNA, 20 bp, synthetic construct
  source 1..20: mol_type = other DNA
ctagtgatgtaatatattct

SEQ ID NO: 3445 - DNA, 20 bp, synthetic construct
  source 1..20: mol_type = other DNA
gtttctctaccacatcagtg

SEQ ID NO: 3446 - DNA, 20 bp, synthetic construct
  source 1..20: mol_type = other DNA
cagtttctctactctagacc

SEQ ID NO: 3447 - DNA, 20 bp, synthetic construct
  source 1..20: mol_type = other DNA
gagtactatagaattcctca

SEQ ID NO: 3448 - DNA, 20 bp, synthetic construct
  source 1..20: mol_type = other DNA
cgggaaattcaattggcaca

SEQ ID NO: 3449 - DNA, 20 bp, synthetic construct
  source 1..20: mol_type = other DNA
ggaatttttctaggagctta

SEQ ID NO: 3450 - DNA, 20 bp, synthetic construct
  source 1..20: mol_type = other DNA
ttcagctgaattcaaaatgt

SEQ ID NO: 3451 - DNA, 20 bp, synthetic construct
  source 1..20: mol_type = other DNA
ccactgttatgatgttggaa

SEQ ID NO: 3452 - DNA, 20 bp, synthetic construct
  source 1..20: mol_type = other DNA
atttctagaaaaatcgacaa

SEQ ID NO: 3453 - DNA, 20 bp, synthetic construct
  source 1..20: mol_type = other DNA
tgtcctatcacagggaatta

SEQ ID NO: 3454 - DNA, 20 bp, synthetic construct
  source 1..20: mol_type = other DNA
gtctgtcaagcctctcaacc

SEQ ID NO: 3455 - DNA, 20 bp, synthetic construct
  source 1..20: mol_type = other DNA
tatcaaaccattttgctttt

SEQ ID NO: 3456 - DNA, 20 bp, synthetic construct
  source 1..20: mol_type = other DNA
cagatttctctagaatgaat

SEQ ID NO: 3457 - DNA, 20 bp, synthetic construct
  source 1..20: mol_type = other DNA
tgtgtctatcttcttcacaa

SEQ ID NO: 3458 - DNA, 20 bp, synthetic construct
  source 1..20: mol_type = other DNA
agactcttagtgcatgccat

SEQ ID NO: 3459 - DNA, 20 bp, synthetic construct
  source 1..20: mol_type = other DNA
ccttagaaacacagtaaact

SEQ ID NO: 3460 - DNA, 20 bp, synthetic construct
  source 1..20: mol_type = other DNA
aaaacagaatatgaaccatt

SEQ ID NO: 3461 - DNA, 20 bp, synthetic construct
  source 1..20: mol_type = other DNA
ggaaaagtactgaaaatgaa

SEQ ID NO: 3462 - DNA, 20 bp, synthetic construct
  source 1..20: mol_type = other DNA
cagactctctgcaaggtaag

SEQ ID NO: 3463 - DNA, 20 bp, synthetic construct
  source 1..20: mol_type = other DNA
cttaaaggaatagtgcttag

SEQ ID NO: 3464 - DNA, 20 bp, synthetic construct
  source 1..20: mol_type = other DNA
aattaccaaatgacccttga

SEQ ID NO: 3465 - DNA, 20 bp, synthetic construct
  source 1..20: mol_type = other DNA
tggtgtttactatgggttcc

SEQ ID NO: 3466 - DNA, 20 bp, synthetic construct
  source 1..20: mol_type = other DNA
tgcaggtcttactcaatagt

SEQ ID NO: 3467 - DNA, 20 bp, synthetic construct
  source 1..20: mol_type = other DNA
cacacaataattagaaaaac

SEQ ID NO: 3468 - DNA, 20 bp, synthetic construct
  source 1..20: mol_type = other DNA
tcatggcaacaaaaatagaa

SEQ ID NO: 3469 - DNA, 20 bp, synthetic construct
  source 1..20: mol_type = other DNA
tgtcaactttaaggataatc

SEQ ID NO: 3470 - DNA, 20 bp, synthetic construct
  source 1..20: mol_type = other DNA
taaatataatgtgtaagaat

SEQ ID NO: 3471 - DNA, 20 bp, synthetic construct
  source 1..20: mol_type = other DNA
caccaacactcaccatgaat

SEQ ID NO: 3472 - DNA, 20 bp, synthetic construct
  source 1..20: mol_type = other DNA
ccctcagggacctctactga

SEQ ID NO: 3473 - DNA, 20 bp, synthetic construct
  source 1..20: mol_type = other DNA
atttatcagtgtctacttag

SEQ ID NO: 3474 - DNA, 20 bp, synthetic construct
  source 1..20: mol_type = other DNA
ttcatttagatgatgttttg

SEQ ID NO: 3475 - DNA, 20 bp, synthetic construct
  source 1..20: mol_type = other DNA
actctactatagagattcta

SEQ ID NO: 3476 - DNA, 20 bp, synthetic construct
  source 1..20: mol_type = other DNA
atttaataatgtgtattaaa

SEQ ID NO: 3477 - DNA, 20 bp, synthetic construct
  source 1..20: mol_type = other DNA
tacaaaccatcttgaaacag

SEQ ID NO: 3478 - DNA, 20 bp, synthetic construct
  source 1..20: mol_type = other DNA
atgagcttgaaagtataaag

SEQ ID NO: 3479 - DNA, 20 bp, synthetic construct
  source 1..20: mol_type = other DNA
gtatcagtgtcctcacctgg

SEQ ID NO: 3480 - DNA, 20 bp, synthetic construct
  source 1..20: mol_type = other DNA
ttcttaagtgggatacaaaa

SEQ ID NO: 3481 - DNA, 20 bp, synthetic construct
  source 1..20: mol_type = other DNA
atagtccttaatgtttgcac

SEQ ID NO: 3482 - DNA, 20 bp, synthetic construct
  source 1..20: mol_type = other DNA
tttcaaagtgaacctgagaa

SEQ ID NO: 3483 - DNA, 20 bp, synthetic construct
  source 1..20: mol_type = other DNA
atctgtttccattgcctgcc

SEQ ID NO: 3484 - DNA, 20 bp, synthetic construct
  source 1..20: mol_type = other DNA
ccttgtcacagtctcttcca

SEQ ID NO: 3485 - DNA, 20 bp, synthetic construct
  source 1..20: mol_type = other DNA
aaaaccattaaatgattaat

SEQ ID NO: 3486 - DNA, 20 bp, synthetic construct
  source 1..20: mol_type = other DNA
aacacactcaagatccaatt

SEQ ID NO: 3487 - DNA, 20 bp, synthetic construct
  source 1..20: mol_type = other DNA
atcacacataatttgaaatg

SEQ ID NO: 3488 - DNA, 20 bp, synthetic construct
  source 1..20: mol_type = other DNA
agtataatacactgaaagct

SEQ ID NO: 3489 - DNA, 20 bp, synthetic construct
  source 1..20: mol_type = other DNA
agctgtaaaaaagttaataa

SEQ ID NO: 3490 - DNA, 20 bp, synthetic construct
  source 1..20: mol_type = other DNA
ttttcaaaccattatgccag

SEQ ID NO: 3491 - DNA, 20 bp, synthetic construct
  source 1..20: mol_type = other DNA
aaacttaatgtgaaacagac

SEQ ID NO: 3492 - DNA, 20 bp, synthetic construct
  source 1..20: mol_type = other DNA
gcaatgtttcaatatgctct

SEQ ID NO: 3493 - DNA, 20 bp, synthetic construct
  source 1..20: mol_type = other DNA
gaatgaagccaagtgaataa

SEQ ID NO: 3494 - DNA, 20 bp, synthetic construct
  source 1..20: mol_type = other DNA
agtgtcagatgcaatgtttt

SEQ ID NO: 3495 - DNA, 20 bp, synthetic construct
  source 1..20: mol_type = other DNA
aggagaaaattacatcctaa

SEQ ID NO: 3496 - DNA, 20 bp, synthetic construct
  source 1..20: mol_type = other DNA
aagaggaaatgtaccctgtg

SEQ ID NO: 3497 - DNA, 20 bp, synthetic construct
  source 1..20: mol_type = other DNA
ctctctctcttgcaaaatta

SEQ ID NO: 3498 - DNA, 20 bp, synthetic construct
  source 1..20: mol_type = other DNA
aattcaaaaggtcaaatttt

SEQ ID NO: 3499 - DNA, 20 bp, synthetic construct
  source 1..20: mol_type = other DNA
ttgttttcataggcacagac

SEQ ID NO: 3500 - DNA, 20 bp, synthetic construct
  source 1..20: mol_type = other DNA
ttcagtaataaaaagctggt

SEQ ID NO: 3501 - DNA, 20 bp, synthetic construct
  source 1..20: mol_type = other DNA
caaggaattgcaagcataaa

SEQ ID NO: 3502 - DNA, 20 bp, synthetic construct
  source 1..20: mol_type = other DNA
gtctaatattacacagcaaa

SEQ ID NO: 3503 - DNA, 20 bp, synthetic construct
  source 1..20: mol_type = other DNA
atatttgctattcatggctc

SEQ ID NO: 3504 - DNA, 20 bp, synthetic construct
  source 1..20: mol_type = other DNA
agcatattttttcttgataa

SEQ ID NO: 3505 - DNA, 20 bp, synthetic construct
  source 1..20: mol_type = other DNA
taaaaatcaccaaatgtgga

SEQ ID NO: 3506 - DNA, 20 bp, synthetic construct
  source 1..20: mol_type = other DNA
gataatatggtggacaaggt

SEQ ID NO: 3507 - DNA, 20 bp, synthetic construct
  source 1..20: mol_type = other DNA
gattcattgatctgaggaga

SEQ ID NO: 3508 - DNA, 20 bp, synthetic construct
  source 1..20: mol_type = other DNA
taaattgctatagccactac

SEQ ID NO: 3509 - DNA, 20 bp, synthetic construct
  source 1..20: mol_type = other DNA
ttgccgacctaggactaaaa

SEQ ID NO: 3510 - DNA, 20 bp, synthetic construct
  source 1..20: mol_type = other DNA
aaaaaatagaaagtcatcac

SEQ ID NO: 3511 - DNA, 20 bp, synthetic construct
  source 1..20: mol_type = other DNA
ttcctctttcacatatactt

SEQ ID NO: 3512 - DNA, 20 bp, synthetic construct
  source 1..20: mol_type = other DNA
taaactaccaattaaaattc

SEQ ID NO: 3513 - DNA, 20 bp, synthetic construct
  source 1..20: mol_type = other DNA
gcacttaacaatatcatata

SEQ ID NO: 3514 - DNA, 20 bp, synthetic construct
  source 1..20: mol_type = other DNA
cctgacattgccactcatga

SEQ ID NO: 3515 - DNA, 20 bp, synthetic construct
  source 1..20: mol_type = other DNA
agctgggaaatggccatctt

SEQ ID NO: 3516 - DNA, 20 bp, synthetic construct
  source 1..20: mol_type = other DNA
ctttcagccacttcaggaga

SEQ ID NO: 3517 - DNA, 20 bp, synthetic construct
  source 1..20: mol_type = other DNA
tttaaccatatttagcttat

SEQ ID NO: 3518 - DNA, 20 bp, synthetic construct
  source 1..20: mol_type = other DNA
gctgtcacctttcccaatgc

SEQ ID NO: 3519 - DNA, 20 bp, synthetic construct
  source 1..20: mol_type = other DNA
aaggtctagtgatgtaatat

SEQ ID NO: 3520 - DNA, 20 bp, synthetic construct
  source 1..20: mol_type = other DNA
ttttatttccttctaaaatg

SEQ ID NO: 3521 - DNA, 20 bp, synthetic construct
  source 1..20: mol_type = other DNA
gcagtttctctactctagac

SEQ ID NO: 3522 - DNA, 20 bp, synthetic construct
  source 1..20: mol_type = other DNA
tgagtactatagaattcctc

SEQ ID NO: 3523 - DNA, 20 bp, synthetic construct
  source 1..20: mol_type = other DNA
cggtcaattacgggaaattc

SEQ ID NO: 3524 - DNA, 20 bp, synthetic construct
  source 1..20: mol_type = other DNA
ctggaatttttctaggagct

SEQ ID NO: 3525 - DNA, 20 bp, synthetic construct
  source 1..20: mol_type = other DNA
tgtggtccacaacttggccc

SEQ ID NO: 3526 - DNA, 20 bp, synthetic construct
  source 1..20: mol_type = other DNA
tcggtaaactgatccaaaac

SEQ ID NO: 3527 - DNA, 20 bp, synthetic construct
  source 1..20: mol_type = other DNA
actaattcagctgaattcaa

SEQ ID NO: 3528 - DNA, 20 bp, synthetic construct
  source 1..20: mol_type = other DNA
taccaccactgttatgatgt

SEQ ID NO: 3529 - DNA, 20 bp, synthetic construct
  source 1..20: mol_type = other DNA
tgcagatttctagaaaaatc

SEQ ID NO: 3530 - DNA, 20 bp, synthetic construct
  source 1..20: mol_type = other DNA
tataaataaatttaaagttt

SEQ ID NO: 3531 - DNA, 20 bp, synthetic construct
  source 1..20: mol_type = other DNA
aaagattgagatgcctcatg

SEQ ID NO: 3532 - DNA, 20 bp, synthetic construct
  source 1..20: mol_type = other DNA
gtaggagacccctttctaca

SEQ ID NO: 3533 - DNA, 20 bp, synthetic construct
  source 1..20: mol_type = other DNA
aatgaagctagaataataga

SEQ ID NO: 3534 - DNA, 20 bp, synthetic construct
  source 1..20: mol_type = other DNA
gagtgatctaatacactcca

SEQ ID NO: 3535 - DNA, 20 bp, synthetic construct
  source 1..20: mol_type = other DNA
ccgtcaaaaaaaaaatacct

SEQ ID NO: 3536 - DNA, 20 bp, synthetic construct
  source 1..20: mol_type = other DNA
ctcgctgcaatacactttgt

SEQ ID NO: 3537 - DNA, 20 bp, synthetic construct
  source 1..20: mol_type = other DNA
caaaacagaatatgaaccat

SEQ ID NO: 3538 - DNA, 20 bp, synthetic construct
  source 1..20: mol_type = other DNA
tattgcctgaatttaaagag

SEQ ID NO: 3539 - DNA, 20 bp, synthetic construct
  source 1..20: mol_type = other DNA
acttttaaatgcattgttgt

SEQ ID NO: 3540 - DNA, 20 bp, synthetic construct
  source 1..20: mol_type = other DNA
tttaaagttgaaactcttaa

SEQ ID NO: 3541 - DNA, 20 bp, synthetic construct
  source 1..20: mol_type = other DNA
tgaattaatatggcatttta

SEQ ID NO: 3542 - DNA, 20 bp, synthetic construct
  source 1..20: mol_type = other DNA
aaacagaggaggaaagtgat

SEQ ID NO: 3543 - DNA, 20 bp, synthetic construct
  source 1..20: mol_type = other DNA
tcagaggcaaaaaacaatat

SEQ ID NO: 3544 - DNA, 20 bp, synthetic construct
  source 1..20: mol_type = other DNA
cgttgtgaaagagcaaaatt

SEQ ID NO: 3545 - DNA, 20 bp, synthetic construct
  source 1..20: mol_type = other DNA
gtacaattcaaacaagagaa

SEQ ID NO: 3546 - DNA, 20 bp, synthetic construct
  source 1..20: mol_type = other DNA
gaaatactgtattcaaaact

SEQ ID NO: 3547 - DNA, 20 bp, synthetic construct
  source 1..20: mol_type = other DNA
gactgttactttctagaaat

SEQ ID NO: 3548 - DNA, 20 bp, synthetic construct
  source 1..20: mol_type = other DNA
ggctaactggaaccagttat

SEQ ID NO: 3549 - DNA, 20 bp, synthetic construct
  source 1..20: mol_type = other DNA
gactctgcttgttgtagtcc

SEQ ID NO: 3550 - DNA, 20 bp, synthetic construct
  source 1..20: mol_type = other DNA
taatgtattgcattggtgct

SEQ ID NO: 3551 - DNA, 20 bp, synthetic construct
  source 1..20: mol_type = other DNA
taaaaattatagtgccatcc

SEQ ID NO: 3552 - DNA, 20 bp, synthetic construct
  source 1..20: mol_type = other DNA
aatgctacagcagagcaggc

SEQ ID NO: 3553 - DNA, 20 bp, synthetic construct
  source 1..20: mol_type = other DNA
aactattggcaaacatagta

SEQ ID NO: 3554 - DNA, 20 bp, synthetic construct
  source 1..20: mol_type = other DNA
catacagacctacaaaccat

SEQ ID NO: 3555 - DNA, 20 bp, synthetic construct
  source 1..20: mol_type = other DNA
cataatatgtacaaaataca

SEQ ID NO: 3556 - DNA, 20 bp, synthetic construct
  source 1..20: mol_type = other DNA
agtgatcctgaataattaac

SEQ ID NO: 3557 - DNA, 20 bp, synthetic construct
  source 1..20: mol_type = other DNA
tttcttaagtgggatacaaa

SEQ ID NO: 3558 - DNA, 20 bp, synthetic construct
  source 1..20: mol_type = other DNA
aattcttccagaggaagaaa

SEQ ID NO: 3559 - DNA, 20 bp, synthetic construct
  source 1..20: mol_type = other DNA
attggagaataggttagaac

SEQ ID NO: 3560 - DNA, 20 bp, synthetic construct
  source 1..20: mol_type = other DNA
gatctgtttccattgcctgc

SEQ ID NO: 3561 - DNA, 20 bp, synthetic construct
  source 1..20: mol_type = other DNA
tgtccagtcattgaatgccg

SEQ ID NO: 3562 - DNA, 20 bp, synthetic construct
  source 1..20: mol_type = other DNA
cttttaataaaagtgatgat

SEQ ID NO: 3563 - DNA, 20 bp, synthetic construct
  source 1..20: mol_type = other DNA
acaacacactcaagatccaa

SEQ ID NO: 3564 - DNA, 20 bp, synthetic construct
  source 1..20: mol_type = other DNA
aacagttaagaataatttga

SEQ ID NO: 3565 - DNA, 20 bp, synthetic construct
  source 1..20: mol_type = other DNA
cactatttgaaaaaatgtct

SEQ ID NO: 3566 - DNA, 20 bp, synthetic construct
  source 1..20: mol_type = other DNA
gactgccactgtactatttg

SEQ ID NO: 3567 - DNA, 20 bp, synthetic construct
  source 1..20: mol_type = other DNA
gcaatcaaatgagttttcaa

SEQ ID NO: 3568 - DNA, 20 bp, synthetic construct
  source 1..20: mol_type = other DNA
atcagtggcctattaaagaa

SEQ ID NO: 3569 - DNA, 20 bp, synthetic construct
  source 1..20: mol_type = other DNA
tgcaatgtttcaatatgctc

SEQ ID NO: 3570 - DNA, 20 bp, synthetic construct
  source 1..20: mol_type = other DNA
caatactccaaaaacatgca

SEQ ID NO: 3571 - DNA, 20 bp, synthetic construct
  source 1..20: mol_type = other DNA
ttagttatgcatagacaaat

SEQ ID NO: 3572 - DNA, 20 bp, synthetic construct
  source 1..20: mol_type = other DNA
atataattatgaaatctatt

SEQ ID NO: 3573 - DNA, 20 bp, synthetic construct
  source 1..20: mol_type = other DNA
gagtatggattgtcatgtct

SEQ ID NO: 3574 - DNA, 20 bp, synthetic construct
  source 1..20: mol_type = other DNA
acaaaaagtctttttgaggc

SEQ ID NO: 3575 - DNA, 20 bp, synthetic construct
  source 1..20: mol_type = other DNA
ttactactatatatatatca

SEQ ID NO: 3576 - DNA, 20 bp, synthetic construct
  source 1..20: mol_type = other DNA
catgtcagttggttagaact

SEQ ID NO: 3577 - DNA, 20 bp, synthetic construct
  source 1..20: mol_type = other DNA
tattactacttgctatgagg

SEQ ID NO: 3578 - DNA, 20 bp, synthetic construct
  source 1..20: mol_type = other DNA
atgagctctctaggcagaca

SEQ ID NO: 3579 - DNA, 20 bp, synthetic construct
  source 1..20: mol_type = other DNA
agtctaatattacacagcaa

SEQ ID NO: 3580 - DNA, 20 bp, synthetic construct
  source 1..20: mol_type = other DNA
tttttccaggtggaaatata

SEQ ID NO: 3581 - DNA, 20 bp, synthetic construct
  source 1..20: mol_type = other DNA
attcaaaaactatttaaatg

SEQ ID NO: 3582 - DNA, 20 bp, synthetic construct
  source 1..20: mol_type = other DNA
taatgagtacacagtaattc

SEQ ID NO: 3583 - DNA, 20 bp, synthetic construct
  source 1..20: mol_type = other DNA
tcagataatatggtggacaa

SEQ ID NO: 3584 - DNA, 20 bp, synthetic construct
  source 1..20: mol_type = other DNA
agaggccctacaaagattca

SEQ ID NO: 3585 - DNA, 20 bp, synthetic construct
  source 1..20: mol_type = other DNA
tcaacaatatagagaggatc

SEQ ID NO: 3586 - DNA, 20 bp, synthetic construct
  source 1..20: mol_type = other DNA
tgtatttaatagaaaatagt

SEQ ID NO: 3587 - DNA, 20 bp, synthetic construct
  source 1..20: mol_type = other DNA
tgaagtgcaaagataattct

SEQ ID NO: 3588 - DNA, 20 bp, synthetic construct
  source 1..20: mol_type = other DNA
ctgagacaacctattgagag

SEQ ID NO: 3589 - DNA, 20 bp, synthetic construct
  source 1..20: mol_type = other DNA
catatcacttgtaattttga

SEQ ID NO: 3590 - DNA, 20 bp, synthetic construct
  source 1..20: mol_type = other DNA
acgcacttaacaatatcata

SEQ ID NO: 3591 - DNA, 20 bp, synthetic construct
  source 1..20: mol_type = other DNA
ttccaccacaatattataac

SEQ ID NO: 3592 - DNA, 20 bp, synthetic construct
  source 1..20: mol_type = other DNA
ctatgagctgggaaatggcc

SEQ ID NO: 3593 - DNA, 20 bp, synthetic construct
  source 1..20: mol_type = other DNA
actttcagccacttcaggag

SEQ ID NO: 3594 - DNA, 20 bp, synthetic construct
  source 1..20: mol_type = other DNA
cattcttgaaacactgtttt

SEQ ID NO: 3595 - DNA, 20 bp, synthetic construct
  source 1..20: mol_type = other DNA
tggctgtcacctttcccaat

SEQ ID NO: 3596 - DNA, 20 bp, synthetic construct
  source 1..20: mol_type = other DNA
ctccagcttttcaagatgct

SEQ ID NO: 3597 - DNA, 20 bp, synthetic construct
  source 1..20: mol_type = other DNA
atgaaatgtggttcttacta

SEQ ID NO: 3598 - DNA, 20 bp, synthetic construct
  source 1..20: mol_type = other DNA
tgcagtttctctactctaga

SEQ ID NO: 3599 - DNA, 20 bp, synthetic construct
  source 1..20: mol_type = other DNA
atgagtactatagaattcct

SEQ ID NO: 3600 - DNA, 20 bp, synthetic construct
  source 1..20: mol_type = other DNA
tccggtcaattacgggaaat

SEQ ID NO: 3601 - DNA, 20 bp, synthetic construct
  source 1..20: mol_type = other DNA
aatgtggtccacaacttggc

SEQ ID NO: 3602 - DNA, 20 bp, synthetic construct
  source 1..20: mol_type = other DNA
gctgctcggtaaactgatcc

SEQ ID NO: 3603 - DNA, 20 bp, synthetic construct
  source 1..20: mol_type = other DNA
tgcttgcattcctgctgttg

SEQ ID NO: 3604 - DNA, 20 bp, synthetic construct
  source 1..20: mol_type = other DNA
aacagggctattttgcttag

SEQ ID NO: 3605 - DNA, 20 bp, synthetic construct
  source 1..20: mol_type = other DNA
tacattacatgggaaactgt

SEQ ID NO: 3606 - DNA, 20 bp, synthetic construct
  source 1..20: mol_type = other DNA
aatacagaaaatctttcatc

SEQ ID NO: 3607 - DNA, 20 bp, synthetic construct
  source 1..20: mol_type = other DNA
atcaggcacttctgaacacc

SEQ ID NO: 3608 - DNA, 20 bp, synthetic construct
  source 1..20: mol_type = other DNA
agtgagtattaaaatgtcag

SEQ ID NO: 3609 - DNA, 20 bp, synthetic construct
  source 1..20: mol_type = other DNA
tgctccccaagtaatgaagc

SEQ ID NO: 3610 - DNA, 20 bp, synthetic construct
  source 1..20: mol_type = other DNA
gattttaatccctatgttat

SEQ ID NO: 3611 - DNA, 20 bp, synthetic construct
  source 1..20: mol_type = other DNA
acttcaatatattccagtgt

SEQ ID NO: 3612 - DNA, 20 bp, synthetic construct
  source 1..20: mol_type = other DNA
tgctattctgacttttgaca

SEQ ID NO: 3613 - DNA, 20 bp, synthetic construct
  source 1..20: mol_type = other DNA
gttaatggtcacttacaaaa

SEQ ID NO: 3614 - DNA, 20 bp, synthetic construct
  source 1..20: mol_type = other DNA
gacactccttttaaaagtcc

SEQ ID NO: 3615 - DNA, 20 bp, synthetic construct
  source 1..20: mol_type = other DNA
ttcagcaaccactctcactt

SEQ ID NO: 3616 - DNA, 20 bp, synthetic construct
  source 1..20: mol_type = other DNA
ttcattgtgtaaaataactt

SEQ ID NO: 3617 - DNA, 20 bp, synthetic construct
  source 1..20: mol_type = other DNA
atcacagatggctctgcaat

SEQ ID NO: 3618 - DNA, 20 bp, synthetic construct
  source 1..20: mol_type = other DNA
ataatagacaattttaccag

SEQ ID NO: 3619 - DNA, 20 bp, synthetic construct
  source 1..20: mol_type = other DNA
agaacattttacacactatc

SEQ ID NO: 3620 - DNA, 20 bp, synthetic construct
  source 1..20: mol_type = other DNA
ctatataatcttagcatctc

SEQ ID NO: 3621 - DNA, 20 bp, synthetic construct
  source 1..20: mol_type = other DNA
cattgaggtaaatgagtaca

SEQ ID NO: 3622 - DNA, 20 bp, synthetic construct
  source 1..20: mol_type = other DNA
ttgatacctagaatgatacg

SEQ ID NO: 3623 - DNA, 20 bp, synthetic construct
  source 1..20: mol_type = other DNA
atagtataaatacagaaaac

SEQ ID NO: 3624 - DNA, 20 bp, synthetic construct
  source 1..20: mol_type = other DNA
ttggctaactggaaccagtt

SEQ ID NO: 3625 - DNA, 20 bp, synthetic construct
  source 1..20: mol_type = other DNA
ggaaggaaaaaacgaatacc

SEQ ID NO: 3626 - DNA, 20 bp, synthetic construct
  source 1..20: mol_type = other DNA
atcttgaaatagtaatgtat

SEQ ID NO: 3627 - DNA, 20 bp, synthetic construct
  source 1..20: mol_type = other DNA
tgggacttgaatataaatgt

SEQ ID NO: 3628 - DNA, 20 bp, synthetic construct
  source 1..20: mol_type = other DNA
ttgataagcaaagtagcctt

SEQ ID NO: 3629 - DNA, 20 bp, synthetic construct
  source 1..20: mol_type = other DNA
taaactattggcaaacatag

SEQ ID NO: 3630 - DNA, 20 bp, synthetic construct
  source 1..20: mol_type = other DNA
aggtgatttatgttttactc

SEQ ID NO: 3631 - DNA, 20 bp, synthetic construct
  source 1..20: mol_type = other DNA
tcagaagatggtaacttacc

SEQ ID NO: 3632 - DNA, 20 bp, synthetic construct
  source 1..20: mol_type = other DNA
taagagatacaccagcaact

SEQ ID NO: 3633 - DNA, 20 bp, synthetic construct
  source 1..20: mol_type = other DNA
ggtttcttaagtgggataca

SEQ ID NO: 3634 - DNA, 20 bp, synthetic construct
  source 1..20: mol_type = other DNA
tacataagaagaaatttaaa

SEQ ID NO: 3635 - DNA, 20 bp, synthetic construct
  source 1..20: mol_type = other DNA
attaacacaaaacaaccctc

SEQ ID NO: 3636 - DNA, 20 bp, synthetic construct
  source 1..20: mol_type = other DNA
cagatctgtttccattgcct

SEQ ID NO: 3637 - DNA, 20 bp, synthetic construct
  source 1..20: mol_type = other DNA
agcaaacccctacttacaca

SEQ ID NO: 3638 - DNA, 20 bp, synthetic construct
  source 1..20: mol_type = other DNA
tctacaacttttaataaaag

SEQ ID NO: 3639 - DNA, 20 bp, synthetic construct
  source 1..20: mol_type = other DNA
aaagataaatttacacatat

SEQ ID NO: 3640 - DNA, 20 bp, synthetic construct
  source 1..20: mol_type = other DNA
agaatttttatccttatact

SEQ ID NO: 3641 - DNA, 20 bp, synthetic construct
  source 1..20: mol_type = other DNA
ccactatttgaaaaaatgtc

SEQ ID NO: 3642 - DNA, 20 bp, synthetic construct
  source 1..20: mol_type = other DNA
attcactcctaaataaaata

SEQ ID NO: 3643 - DNA, 20 bp, synthetic construct
  source 1..20: mol_type = other DNA
atgatctctaatagattaaa

SEQ ID NO: 3644 - DNA, 20 bp, synthetic construct
  source 1..20: mol_type = other DNA
acatgatttgtcatgaacac

SEQ ID NO: 3645 - DNA, 20 bp, synthetic construct
  source 1..20: mol_type = other DNA
taagtgctctgggtcacact

SEQ ID NO: 3646 - DNA, 20 bp, synthetic construct
  source 1..20: mol_type = other DNA
agcaccaatactccaaaaac

SEQ ID NO: 3647 - DNA, 20 bp, synthetic construct
  source 1..20: mol_type = other DNA
attagttatgcatagacaaa

SEQ ID NO: 3648 - DNA, 20 bp, synthetic construct
  source 1..20: mol_type = other DNA
aatctatgacaatataatta

SEQ ID NO: 3649 - DNA, 20 bp, synthetic construct
  source 1..20: mol_type = other DNA
atatggagtatggattgtca

SEQ ID NO: 3650 - DNA, 20 bp, synthetic construct
  source 1..20: mol_type = other DNA
actagtttttattctacctt

SEQ ID NO: 3651 - DNA, 20 bp, synthetic construct
  source 1..20: mol_type = other DNA
ctaacatatactcttggagc

SEQ ID NO: 3652 - DNA, 20 bp, synthetic construct
  source 1..20: mol_type = other DNA
aatcttttttttaatgccca

SEQ ID NO: 3653 - DNA, 20 bp, synthetic construct
  source 1..20: mol_type = other DNA
tgatgggttctagagcagaa

SEQ ID NO: 3654 - DNA, 20 bp, synthetic construct
  source 1..20: mol_type = other DNA
gctaacacttcatgacacac

SEQ ID NO: 3655 - DNA, 20 bp, synthetic construct
  source 1..20: mol_type = other DNA
agcatcaaaaattctgtgct

SEQ ID NO: 3656 - DNA, 20 bp, synthetic construct
  source 1..20: mol_type = other DNA
gtggtccagtccaccttcat

SEQ ID NO: 3657 - DNA, 20 bp, synthetic construct
  source 1..20: mol_type = other DNA
ttatgcttcccttcttagaa

SEQ ID NO: 3658 - DNA, 20 bp, synthetic construct
  source 1..20: mol_type = other DNA
aaaacattccaggataatga

SEQ ID NO: 3659 - DNA, 20 bp, synthetic construct
  source 1..20: mol_type = other DNA
taaaacatgacaagagttct

SEQ ID NO: 3660 - DNA, 20 bp, synthetic construct
  source 1..20: mol_type = other DNA
tcttaatttggtagttagat

SEQ ID NO: 3661 - DNA, 20 bp, synthetic construct
  source 1..20: mol_type = other DNA
gatgaaagtaggccccactc

SEQ ID NO: 3662 - DNA, 20 bp, synthetic construct
  source 1..20: mol_type = other DNA
tgtcagagagccactacgct

SEQ ID NO: 3663 - DNA, 20 bp, synthetic construct
  source 1..20: mol_type = other DNA
ttctctattcagaggcagaa

SEQ ID NO: 3664 - DNA, 20 bp, synthetic construct
  source 1..20: mol_type = other DNA
ttcaactagagaatgcaaca

SEQ ID NO: 3665 - DNA, 20 bp, synthetic construct
  source 1..20: mol_type = other DNA
aaagatccatcataaaacat

SEQ ID NO: 3666 - DNA, 20 bp, synthetic construct
  source 1..20: mol_type = other DNA
ttaacaatatcatataatct

SEQ ID NO: 3667 - DNA, 20 bp, synthetic construct
  source 1..20: mol_type = other DNA
tgccactcatgaggacttcc

SEQ ID NO: 3668 - DNA, 20 bp, synthetic construct
  source 1..20: mol_type = other DNA
taaggagattatttagtgcc

SEQ ID NO: 3669 - DNA, 20 bp, synthetic construct
  source 1..20: mol_type = other DNA
tcagccacttcaggagaatg

SEQ ID NO: 3670 - DNA, 20 bp, synthetic construct
  source 1..20: mol_type = other DNA
accatatttagcttatgatg

SEQ ID NO: 3671 - DNA, 20 bp, synthetic construct
  source 1..20: mol_type = other DNA
tcacctttcccaatgcttat

SEQ ID NO: 3672 - DNA, 20 bp, synthetic construct
  source 1..20: mol_type = other DNA
aaatcttcatgatcaaaaat

SEQ ID NO: 3673 - DNA, 20 bp, synthetic construct
  source 1..20: mol_type = other DNA
gtaggatctaaaaccactga

SEQ ID NO: 3674 - DNA, 20 bp, synthetic construct
  source 1..20: mol_type = other DNA
tctagaccataaatatgctt

SEQ ID NO: 3675 - DNA, 20 bp, synthetic construct
  source 1..20: mol_type = other DNA
tactatagaattcctcacga

SEQ ID NO: 3676 - DNA, 20 bp, synthetic construct
  source 1..20: mol_type = other DNA
attcaattggcacattttta

SEQ ID NO: 3677 - DNA, 20 bp, synthetic construct
  source 1..20: mol_type = other DNA
aatttttctaggagcttaaa

SEQ ID NO: 3678 - DNA, 20 bp, synthetic construct
  source 1..20: mol_type = other DNA
gtccacaacttggcccaaaa

SEQ ID NO: 3679 - DNA, 20 bp, synthetic construct
  source 1..20: mol_type = other DNA
caggtcagccaaaatcaagt

SEQ ID NO: 3680 - DNA, 20 bp, synthetic construct
  source 1..20: mol_type = other DNA
tttcttgaggattttctttc

SEQ ID NO: 3681 - DNA, 20 bp, synthetic construct
  source 1..20: mol_type = other DNA
attacatttctttccgttga

SEQ ID NO: 3682 - DNA, 20 bp, synthetic construct
  source 1..20: mol_type = other DNA
aaattatcggccttataaat

SEQ ID NO: 3683 - DNA, 20 bp, synthetic construct
  source 1..20: mol_type = other DNA
ggccaaagaatttaccgaaa

SEQ ID NO: 3684 - DNA, 20 bp, synthetic construct
  source 1..20: mol_type = other DNA
tttttaaggccccctttaaa

SEQ ID NO: 3685 - DNA, 20 bp, synthetic construct
  source 1..20: mol_type = other DNA
ttaggtctgtcacaagctct

SEQ ID NO: 3686 - DNA, 20 bp, synthetic construct
  source 1..20: mol_type = other DNA
cagtctgtttacaagatgcc

SEQ ID NO: 3687 - DNA, 20 bp, synthetic construct
  source 1..20: mol_type = other DNA
tgaacagttggtttgtacag

SEQ ID NO: 3688 - DNA, 20 bp, synthetic construct
  source 1..20: mol_type = other DNA
ggactgatgaggacaattca

SEQ ID NO: 3689 - DNA, 20 bp, synthetic construct
  source 1..20: mol_type = other DNA
aggtgatctatcccattctg

SEQ ID NO: 3690 - DNA, 20 bp, synthetic construct
  source 1..20: mol_type = other DNA
gtggctaaatttcaaagcct

SEQ ID NO: 3691 - DNA, 20 bp, synthetic construct
  source 1..20: mol_type = other DNA
tggaaatgtaatgtattggt

SEQ ID NO: 3692 - DNA, 20 bp, synthetic construct
  source 1..20: mol_type = other DNA
gcagttggtttagactcccc

SEQ ID NO: 3693 - DNA, 20 bp, synthetic construct
  source 1..20: mol_type = other DNA
aggaaaaactttacctgata

SEQ ID NO: 3694 - DNA, 20 bp, synthetic construct
  source 1..20: mol_type = other DNA
attttctatcatataaaatc

SEQ ID NO: 3695 - DNA, 20 bp, synthetic construct
  source 1..20: mol_type = other DNA
taaaattttgtatatgtcat

SEQ ID NO: 3696 - DNA, 20 bp, synthetic construct
  source 1..20: mol_type = other DNA
aggtcttactcaatagtcac

SEQ ID NO: 3697 - DNA, 20 bp, synthetic construct
  source 1..20: mol_type = other DNA
ctgaaattaactgagatttt

SEQ ID NO: 3698 - DNA, 20 bp, synthetic construct
  source 1..20: mol_type = other DNA
tataaaaattaatctaagtg

SEQ ID NO: 3699 - DNA, 20 bp, synthetic construct
  source 1..20: mol_type = other DNA
ctgattgaatagccaccaga

SEQ ID NO: 3700 - DNA, 20 bp, synthetic construct
  source 1..20: mol_type = other DNA
aagctcagagttacttggac

SEQ ID NO: 3701 - DNA, 20 bp, synthetic construct
  source 1..20: mol_type = other DNA
gacgcggcaactgtggcaat

SEQ ID NO: 3702 - DNA, 20 bp, synthetic construct
  source 1..20: mol_type = other DNA
atgaatgattaccatgtaag

SEQ ID NO: 3703 - DNA, 20 bp, synthetic construct
  source 1..20: mol_type = other DNA
tccaacatcatatgactgat

SEQ ID NO: 3704 - DNA, 20 bp, synthetic construct
  source 1..20: mol_type = other DNA
cagtttctcaccctgtgtcc

SEQ ID NO: 3705 - DNA, 20 bp, synthetic construct
  source 1..20: mol_type = other DNA
agttacaaaaaatatttcct

SEQ ID NO: 3706 - DNA, 20 bp, synthetic construct
  source 1..20: mol_type = other DNA
gaattatattttgaagggag

SEQ ID NO: 3707 - DNA, 20 bp, synthetic construct
  source 1..20: mol_type = other DNA
ccattttatattctctatta

SEQ ID NO: 3708 - DNA, 20 bp, synthetic construct
  source 1..20: mol_type = other DNA
tacatgtaagcatataaaaa

SEQ ID NO: 3709 - DNA, 20 bp, synthetic construct
  source 1..20: mol_type = other DNA
cctgatggaatttcaaagtt

SEQ ID NO: 3710 - DNA, 20 bp, synthetic construct
  source 1..20: mol_type = other DNA
ttaagtgggatacaaaaagc

SEQ ID NO: 3711 - DNA, 20 bp, synthetic construct
  source 1..20: mol_type = other DNA
atatttctctatcaaataca

SEQ ID NO: 3712 - DNA, 20 bp, synthetic construct
  source 1..20: mol_type = other DNA
ggctcccaatttcctcaact

SEQ ID NO: 3713 - DNA, 20 bp, synthetic construct
  source 1..20: mol_type = other DNA
tgtttccattgcctgccctc

SEQ ID NO: 3714 - DNA, 20 bp, synthetic construct
  source 1..20: mol_type = other DNA
aattgaaggattaccaagtt

SEQ ID NO: 3715 - DNA, 20 bp, synthetic construct
  source 1..20: mol_type = other DNA
tgcatgtttagtttaagact

SEQ ID NO: 3716 - DNA, 20 bp, synthetic construct
  source 1..20: mol_type = other DNA
gtttttacacaatgatccac

SEQ ID NO: 3717 - DNA, 20 bp, synthetic construct
  source 1..20: mol_type = other DNA
tcatgaaattggtatttaga

SEQ ID NO: 3718 - DNA, 20 bp, synthetic construct
  source 1..20: mol_type = other DNA
agagattttaggcagaagag

SEQ ID NO: 3719 - DNA, 20 bp, synthetic construct
  source 1..20: mol_type = other DNA
tgtatgcagccaattacatg

SEQ ID NO: 3720 - DNA, 20 bp, synthetic construct
  source 1..20: mol_type = other DNA
aaaccattatgccagaatgc

SEQ ID NO: 3721 - DNA, 20 bp, synthetic construct
  source 1..20: mol_type = other DNA
cttttggatattattatatt

SEQ ID NO: 3722 - DNA, 20 bp, synthetic construct
  source 1..20: mol_type = other DNA
aataattttaggaactcggg

SEQ ID NO: 3723 - DNA, 20 bp, synthetic construct
  source 1..20: mol_type = other DNA
acattatcttgactttatca

SEQ ID NO: 3724 - DNA, 20 bp, synthetic construct
  source 1..20: mol_type = other DNA
tagactacagttagtttgac

SEQ ID NO: 3725 - DNA, 20 bp, synthetic construct
  source 1..20: mol_type = other DNA
attacctaggagaaactctg

SEQ ID NO: 3726 - DNA, 20 bp, synthetic construct
  source 1..20: mol_type = other DNA
ttctgtaaatgaacatggga

SEQ ID NO: 3727 - DNA, 20 bp, synthetic construct
  source 1..20: mol_type = other DNA
ctctcctgttcagaaacaaa

SEQ ID NO: 3728 - DNA, 20 bp, synthetic construct
  source 1..20: mol_type = other DNA
gagggcgaggaaactaactc

SEQ ID NO: 3729 - DNA, 20 bp, synthetic construct
  source 1..20: mol_type = other DNA
caccattcccttagtttgcc

SEQ ID NO: 3730 - DNA, 20 bp, synthetic construct
  source 1..20: mol_type = other DNA
aagtgcatgagtccacatat

SEQ ID NO: 3731 - DNA, 20 bp, synthetic construct
  source 1..20: mol_type = other DNA
tagagtcaaggacctggtgg

SEQ ID NO: 3732 - DNA, 20 bp, synthetic construct
  source 1..20: mol_type = other DNA
cttctgtttgagtatataat

SEQ ID NO: 3733 - DNA, 20 bp, synthetic construct
  source 1..20: mol_type = other DNA
ttagagttgcatatggttta

SEQ ID NO: 3734 - DNA, 20 bp, synthetic construct
  source 1..20: mol_type = other DNA
atttggaatcacaggctctt

SEQ ID NO: 3735 - DNA, 20 bp, synthetic construct
  source 1..20: mol_type = other DNA
ttatgcactaaacaaaaaaa

SEQ ID NO: 3736 - DNA, 20 bp, synthetic construct
  source 1..20: mol_type = other DNA
tgggaccccaaaggactgca

SEQ ID NO: 3737 - DNA, 20 bp, synthetic construct
  source 1..20: mol_type = other DNA
tttatttaattttcagcaat

SEQ ID NO: 3738 - DNA, 20 bp, synthetic construct
  source 1..20: mol_type = other DNA
atatcaaagggattcctata

SEQ ID NO: 3739 - DNA, 20 bp, synthetic construct
  source 1..20: mol_type = other DNA
cctctcagtcggtgtgtact

SEQ ID NO: 3740 - DNA, 20 bp, synthetic construct
  source 1..20: mol_type = other DNA
tagactattgcaattatttc

SEQ ID NO: 3741 - DNA, 20 bp, synthetic construct
  source 1..20: mol_type = other DNA
tattttcttcaccatgttca

SEQ ID NO: 3742 - DNA, 20 bp, synthetic construct
  source 1..20: mol_type = other DNA
taccatatgtaatattttct

SEQ ID NO: 3743 - DNA, 20 bp, synthetic construct
  source 1..20: mol_type = other DNA
cctgctgcacactcgcgact

SEQ ID NO: 3744 - DNA, 20 bp, synthetic construct
  source 1..20: mol_type = other DNA
cttccacattattgcaagga

SEQ ID NO: 3745 - DNA, 20 bp, synthetic construct
  source 1..20: mol_type = other DNA
gctgcattctctgggtactg

SEQ ID NO: 3746 - DNA, 20 bp, synthetic construct
  source 1..20: mol_type = other DNA
aatgtatatgcttctgcatt

SEQ ID NO: 3747 - DNA, 20 bp, synthetic construct
  source 1..20: mol_type = other DNA
tttacagccactttcagcca

SEQ ID NO: 3748 - DNA, 20 bp, synthetic construct
  source 1..20: mol_type = other DNA
atcctttagtctgtatttca

SEQ ID NO: 3749 - DNA, 20 bp, synthetic construct
  source 1..20: mol_type = other DNA
gacagcacatcttcagaaaa

SEQ ID NO: 3750 - DNA, 20 bp, synthetic construct
  source 1..20: mol_type = other DNA
aaatgtgtcaaactcttcag

SEQ ID NO: 3751 - DNA, 20 bp, synthetic construct
  source 1..20: mol_type = other DNA
tgcgggacctggtaggtact

SEQ ID NO: 3752 - DNA, 20 bp, synthetic construct
  source 1..20: mol_type = other DNA
cccatttcattgggaaagga

SEQ ID NO: 3753 - DNA, 20 bp, synthetic construct
  source 1..20: mol_type = other DNA
agttccttggtgattttact

SEQ ID NO: 3754 - DNA, 20 bp, synthetic construct
  source 1..20: mol_type = other DNA
attttacaaagccacttggg

SEQ ID NO: 3755 - DNA, 20 bp, synthetic construct
  source 1..20: mol_type = other DNA
ggcatttcatatagtcggat

SEQ ID NO: 3756 - DNA, 20 bp, synthetic construct
  source 1..20: mol_type = other DNA
gccttggttgatctggattt

SEQ ID NO: 3757 - DNA, 20 bp, synthetic construct
  source 1..20: mol_type = other DNA
gtgcaatcctgtgctgtagg

SEQ ID NO: 3758 - DNA, 20 bp, synthetic construct
  source 1..20: mol_type = other DNA
tactatcagcaacttcctca

SEQ ID NO: 3759 - DNA, 20 bp, synthetic construct
  source 1..20: mol_type = other DNA
cgtataagtcgacgagttga

SEQ ID NO: 3760 - DNA, 20 bp, synthetic construct
  source 1..20: mol_type = other DNA
tcagggtatccacattcaaa

SEQ ID NO: 3761 - DNA, 20 bp, synthetic construct
  source 1..20: mol_type = other DNA
ttacctgctgcacactcgcg

SEQ ID NO: 3762 - DNA, 20 bp, synthetic construct
  source 1..20: mol_type = other DNA
tccttattttccagcatact

SEQ ID NO: 3763 - DNA, 20 bp, synthetic construct
  source 1..20: mol_type = other DNA
tctctctaagagagaaggtt

SEQ ID NO: 3764 - DNA, 20 bp, synthetic construct
  source 1..20: mol_type = other DNA
cttcatggtttgaattcaaa

SEQ ID NO: 3765 - DNA, 20 bp, synthetic construct
  source 1..20: mol_type = other DNA
aaatcatcaattgtatacct

SEQ ID NO: 3766 - DNA, 20 bp, synthetic construct
  source 1..20: mol_type = other DNA
ctcaatcagtacttctagcc

SEQ ID NO: 3767 - DNA, 20 bp, synthetic construct
  source 1..20: mol_type = other DNA
agtttatctagcttgagaat

SEQ ID NO: 3768 - DNA, 20 bp, synthetic construct
  source 1..20: mol_type = other DNA
aaaccatggcctttctctat

SEQ ID NO: 3769 - DNA, 20 bp, synthetic construct
  source 1..20: mol_type = other DNA
ccaaaacattattatccaga

SEQ ID NO: 3770 - DNA, 20 bp, synthetic construct
  source 1..20: mol_type = other DNA
agaaatttgggttctcagcc

SEQ ID NO: 3771 - DNA, 20 bp, synthetic construct
  source 1..20: mol_type = other DNA
aaatgcctctgtaagaatcc

SEQ ID NO: 3772 - DNA, 20 bp, synthetic construct
  source 1..20: mol_type = other DNA
aagtgaggagaagagaatgg

SEQ ID NO: 3773 - DNA, 20 bp, synthetic construct
  source 1..20: mol_type = other DNA
tctaaaggtgccccaacaga

SEQ ID NO: 3774 - DNA, 20 bp, synthetic construct
  source 1..20: mol_type = other DNA
atcacatacacattctaaaa

SEQ ID NO: 3775 - DNA, 20 bp, synthetic construct
  source 1..20: mol_type = other DNA
atagattagttagactgatg

SEQ ID NO: 3776 - DNA, 20 bp, synthetic construct
  source 1..20: mol_type = other DNA
ttctgcttgaaatgtcttcc

SEQ ID NO: 3777 - DNA, 20 bp, synthetic construct
  source 1..20: mol_type = other DNA
tctttgttctatcacttgag

SEQ ID NO: 3778 - DNA, 20 bp, synthetic construct
  source 1..20: mol_type = other DNA
ccttcttctctttttcatac

SEQ ID NO: 3779 - DNA, 20 bp, synthetic construct
  source 1..20: mol_type = other DNA
taaaaatttagtccttcatc

SEQ ID NO: 3780 - DNA, 20 bp, synthetic construct
  source 1..20: mol_type = other DNA
agggtgcatagtctgtaggt

SEQ ID NO: 3781 - DNA, 20 bp, synthetic construct
  source 1..20: mol_type = other DNA
ctgtttggcaggcaaggcca

SEQ ID NO: 3782 - DNA, 20 bp, synthetic construct
  source 1..20: mol_type = other DNA
attctaaatcctgaattcaa

SEQ ID NO: 3783 - DNA, 20 bp, synthetic construct
  source 1..20: mol_type = other DNA
aggatgttcatttaactata

SEQ ID NO: 3784 - DNA, 20 bp, synthetic construct
  source 1..20: mol_type = other DNA
gaatatggaaagaggaataa

SEQ ID NO: 3785 - DNA, 20 bp, synthetic construct
  source 1..20: mol_type = other DNA
tccatcagttactgtgctaa

SEQ ID NO: 3786 - DNA, 20 bp, synthetic construct
  source 1..20: mol_type = other DNA
gaagagagaatttagagcta

SEQ ID NO: 3787 - DNA, 20 bp, synthetic construct
  source 1..20: mol_type = other DNA
aaagcccctcactccatttt

SEQ ID NO: 3788 - DNA, 20 bp, synthetic construct
  source 1..20: mol_type = other DNA
aagttagttgattaaaaatt

SEQ ID NO: 3789 - DNA, 20 bp, synthetic construct
  source 1..20: mol_type = other DNA
ataaatttggctggcaataa

SEQ ID NO: 3790 - DNA, 20 bp, synthetic construct
  source 1..20: mol_type = other DNA
gttaatggtatttataatta

SEQ ID NO: 3791 - DNA, 20 bp, synthetic construct
  source 1..20: mol_type = other DNA
attttcagagagctatccta

SEQ ID NO: 3792 - DNA, 20 bp, synthetic construct
  source 1..20: mol_type = other DNA
ctttcttacccttctaaaat

SEQ ID NO: 3793 - DNA, 20 bp, synthetic construct
  source 1..20: mol_type = other DNA
ctgagatgacacactgacca

SEQ ID NO: 3794 - DNA, 20 bp, synthetic construct
  source 1..20: mol_type = other DNA
ctcttcaagacattgaaagt

SEQ ID NO: 3795 - DNA, 20 bp, synthetic construct
  source 1..20: mol_type = other DNA
gaaatgaagggctttggaat

SEQ ID NO: 3796 - DNA, 20 bp, synthetic construct
  source 1..20: mol_type = other DNA
ataagaagttgaatcagaaa

SEQ ID NO: 3797 - DNA, 20 bp, synthetic construct
  source 1..20: mol_type = other DNA
ctcttaacccagagaattag

SEQ ID NO: 3798 - DNA, 20 bp, synthetic construct
  source 1..20: mol_type = other DNA
acagagcatatttcacacat

SEQ ID NO: 3799 - DNA, 20 bp, synthetic construct
  source 1..20: mol_type = other DNA
ccacagaatcttcaggaatt

SEQ ID NO: 3800 - DNA, 20 bp, synthetic construct
  source 1..20: mol_type = other DNA
ttggataaattattcaacct

SEQ ID NO: 3801 - DNA, 20 bp, synthetic construct
  source 1..20: mol_type = other DNA
tgatcatgctaaacgcaaaa

SEQ ID NO: 3802 - DNA, 20 bp, synthetic construct
  source 1..20: mol_type = other DNA
gaatattgaaacatggttac

SEQ ID NO: 3803 - DNA, 20 bp, synthetic construct
  source 1..20: mol_type = other DNA
tcttggtattctctcattct

SEQ ID NO: 3804 - DNA, 20 bp, synthetic construct
  source 1..20: mol_type = other DNA
ttacaacacactatgtatca

SEQ ID NO: 3805 - DNA, 20 bp, synthetic construct
  source 1..20: mol_type = other DNA
attaaaccaatataccaagg

SEQ ID NO: 3806 - DNA, 20 bp, synthetic construct
  source 1..20: mol_type = other DNA
gcaattcaaaaaaagtccga

SEQ ID NO: 3807 - DNA, 20 bp, synthetic construct
  source 1..20: mol_type = other DNA
tgagagaaattgttagaagc

SEQ ID NO: 3808 - DNA, 20 bp, synthetic construct
  source 1..20: mol_type = other DNA
tttatagaacacagactctt

SEQ ID NO: 3809 - DNA, 20 bp, synthetic construct
  source 1..20: mol_type = other DNA
agggaggtaagattccacag

SEQ ID NO: 3810 - DNA, 20 bp, synthetic construct
  source 1..20: mol_type = other DNA
catatgtcagagggtcctaa

SEQ ID NO: 3811 - DNA, 20 bp, synthetic construct
  source 1..20: mol_type = other DNA
tttgctaaaattatctgtgc

SEQ ID NO: 3812 - DNA, 20 bp, synthetic construct
  source 1..20: mol_type = other DNA
gatggtgaaaattataggag

SEQ ID NO: 3813 - DNA, 20 bp, synthetic construct
  source 1..20: mol_type = other DNA
aaaaacccttgggccaacaa

SEQ ID NO: 3814 - DNA, 20 bp, synthetic construct
  source 1..20: mol_type = other DNA
ccctgctgtgataggcttga

SEQ ID NO: 3815 - DNA, 20 bp, synthetic construct
  source 1..20: mol_type = other DNA
ttgaaagaggtttatattaa

SEQ ID NO: 3816 - DNA, 20 bp, synthetic construct
  source 1..20: mol_type = other DNA
ggtgtcactgtcatattata

SEQ ID NO: 3817 - DNA, 20 bp, synthetic construct
  source 1..20: mol_type = other DNA
atagtctaattcatgacaaa

SEQ ID NO: 3818 - DNA, 20 bp, synthetic construct
  source 1..20: mol_type = other DNA
ctatgtaggccctaggctag

SEQ ID NO: 3819 - DNA, 17 bp, synthetic construct
  source 1..17: mol_type = other DNA
ccctttccatgtgaaca

SEQ ID NO: 3820 - DNA, 20 bp, synthetic construct
  source 1..20: mol_type = other DNA
catatctaaagaccgcaagc

SEQ ID NO: 3821 - DNA, 20 bp, synthetic construct
  source 1..20: mol_type = other DNA
gttccttcagtctcaagggg

SEQ ID NO: 3822 - DNA, 20 bp, synthetic construct
  source 1..20: mol_type = other DNA
ttccttcagtctcaaggggg

SEQ ID NO: 3823 - DNA, 20 bp, synthetic construct
  source 1..20: mol_type = other DNA
tccttcagtctcaaggggga

SEQ ID NO: 3824 - DNA, 20 bp, synthetic construct
  source 1..20: mol_type = other DNA
tcataagtttcattcggtta

SEQ ID NO: 3825 - DNA, 20 bp, synthetic construct
  source 1..20: mol_type = other DNA
ctttctcacatacctattaa

SEQ ID NO: 3826 - DNA, 20 bp, synthetic construct
  source 1..20: mol_type = other DNA
tctttctcacatacctatta

SEQ ID NO: 3827 - DNA, 20 bp, synthetic construct
  source 1..20: mol_type = other DNA
ctctttctcacatacctatt

SEQ ID NO: 3828 - DNA, 20 bp, synthetic construct
  source 1..20: mol_type = other DNA
tctctttctcacatacctat

SEQ ID NO: 3829 - DNA, 17 bp, synthetic construct
  source 1..17: mol_type = other DNA
taacaatatcatataat

SEQ ID NO: 3830 - DNA, 17 bp, synthetic construct
  source 1..17: mol_type = other DNA
ttaacaatatcatataa

SEQ ID NO: 3831 - DNA, 17 bp, synthetic construct
  source 1..17: mol_type = other DNA
cttaacaatatcatata

SEQ ID NO: 3832 - DNA, 17 bp, synthetic construct
  source 1..17: mol_type = other DNA
acttaacaatatcatat

SEQ ID NO: 3833 - DNA, 17 bp, synthetic construct
  source 1..17: mol_type = other DNA
cacttaacaatatcata

SEQ ID NO: 3834 - DNA, 17 bp, synthetic construct
  source 1..17: mol_type = other DNA
agcactgaatccatagc

SEQ ID NO: 3835 - DNA, 17 bp, synthetic construct
  source 1..17: mol_type = other DNA
acatttctgaatcccag

SEQ ID NO: 3836 - DNA, 17 bp, synthetic construct
  source 1..17: mol_type = other DNA
ccttcagtctcaagggg

SEQ ID NO: 3837 - DNA, 17 bp, synthetic construct
  source 1..17: mol_type = other DNA
atatctaaagaccgcaa

SEQ ID NO: 3838 - DNA, 17 bp, synthetic construct
  source 1..17: mol_type = other DNA
aaactcatggacttcgt

SEQ ID NO: 3839 - DNA, 17 bp, synthetic construct
  source 1..17: mol_type = other DNA
cattcggttataaggca

SEQ ID NO: 3840 - DNA, 17 bp, synthetic construct
  source 1..17: mol_type = other DNA
accctttccatgtgaac

SEQ ID NO: 3841 - DNA, 17 bp, synthetic construct
  source 1..17: mol_type = other DNA
tttcatagcttccacca

SEQ ID NO: 3842 - DNA, 17 bp, synthetic construct
  source 1..17: mol_type = other DNA
catgaggacttccacat

SEQ ID NO: 3843 - DNA, 17 bp, synthetic construct
  source 1..17: mol_type = other DNA
catggcatcaaaaatta

SEQ ID NO: 3844 - DNA, 17 bp, synthetic construct
  source 1..17: mol_type = other DNA
cacaaactcatggactt

SEQ ID NO: 3845 - DNA, 17 bp, synthetic construct
  source 1..17: mol_type = other DNA
agttccttcagtctcaa

SEQ ID NO: 3846 - DNA, 17 bp, synthetic construct
  source 1..17: mol_type = other DNA
ttcggttataaggcaca

SEQ ID NO: 3847 - DNA, 17 bp, synthetic construct
  source 1..17: mol_type = other DNA
atttagcttatgatgaa

SEQ ID NO: 3848 - DNA, 20 bp, synthetic construct
  source 1..20: mol_type = other DNA
cctataggactatccaggaa

SEQ ID NO: 3849 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphodiester
  modified_base 4: mod_base = OTHER; note = 2'-MOE 5-methyl cytidine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-deoxyguanosine 3'-phosphorothioate
  modified_base 15: mod_base = OTHER; note = 2'-deoxyadenosine 3'-phosphorothioate
  modified_base 16..17: mod_base = OTHER; note = 2'-MOE 5-methyl cytidine 3'-phosphodiester
  modified_base 18: mod_base = OTHER; note = 2'-MOE guanosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
gctcatatctaaagaccgca

SEQ ID NO: 3850 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphodiester
  modified_base 4: mod_base = OTHER; note = 2'-MOE 5-methyl cytidine 3'-phosphodiester
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7: mod_base = OTHER; note = 5-methyl 2'-deoxycytidine 3'-phosphorothioate
  modified_base 8..10: mod_base = OTHER; note = 2'-deoxyadenosine 3'-phosphorothioate
  modified_base 11: mod_base = OTHER; note = 5-methyl 2'-deoxycytidine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16..17: mod_base = OTHER; note = 2'-MOE guanosine 3'-phosphodiester
  modified_base 18: mod_base = OTHER; note = 2'-MOE adenosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE thymidine
tcaccacaaactcatggact

SEQ ID NO: 3851 - DNA, 20 bp, synthetic construct
  source 1..20: mol_type = other DNA
  modified_base 1: mod_base = OTHER; note = 2'-MOE adenosine 3'-phosphorothioate
  modified_base 2..4: mod_base = OTHER; note = 2'-MOE 5-methyl cytidine 3'-phosphodiester
  modified_base 5: mod_base = OTHER; note = 2'-MOE thymidine 3'-phosphorothioate
  modified_base 6..7: mod_base = OTHER; note = 2'-deoxythymidine 3'-phosphorothioate
  modified_base 8..9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphodiester
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE thymidine
accctttccatgtgaacatt

SEQ ID NO: 3852 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE 5-methyl cytidine 3'-phosphodiester
  modified_base 3: mod_base = OTHER; note = 2'-MOE guanosine 3'-phosphodiester
  modified_base 4: mod_base = OTHER; note = 2'-MOE 5-methyl cytidine 3'-phosphodiester
  modified_base 5: mod_base = OTHER; note = 2'-MOE adenosine 3'-phosphorothioate
  modified_base 6: mod_base = OTHER; note = 5-methyl 2'-deoxycytidine 3'-phosphorothioate
  modified_base 7..8: mod_base = OTHER; note = 2'-deoxythymidine 3'-phosphorothioate
  modified_base 9..10: mod_base = OTHER; note = 2'-deoxyadenosine 3'-phosphorothioate
  modified_base 11: mod_base = OTHER; note = 5-methyl 2'-deoxycytidine 3'-phosphorothioate
  modified_base 12..13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 2'-deoxyadenosine 3'-phosphorothioate
  modified_base 16: mod_base = OTHER; note = 2'-MOE thymidine 3'-phosphodiester
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE adenosine
acgcacttaacaatatcata

SEQ ID NO: 3853 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE 5-methyl cytidine 3'-phosphodiester
  modified_base 4: mod_base = OTHER; note = 2'-MOE adenosine 3'-phosphodiester
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11..12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 2'-deoxyadenosine 3'-phosphorothioate
  modified_base 15: mod_base = OTHER; note = 2'-deoxyguanosine 3'-phosphorothioate
  modified_base 16: mod_base = OTHER; note = 2'-MOE 5-methyl cytidine 3'-phosphodiester
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE adenosine 3'-phosphorothioate
  modified_base 20: mod_base = OTHER; note = 2'-MOE 5-methyl cytidine
agcaatcattggtagcatac

SEQ ID NO: 3854 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE guanosine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE 5-methyl cytidine 3'-phosphorothioate
  modified_base 6..7: mod_base = OTHER; note = 2'-deoxythymidine 3'-phosphorothioate
  modified_base 8..9: mod_base = OTHER; note = 2'-deoxyadenosine 3'-phosphorothioate
  modified_base 10: mod_base = OTHER; note = 5-methyl 2'-deoxycytidine 3'-phosphorothioate
  modified_base 11..12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE adenosine 3'-phosphorothioate
  modified_base 20: mod_base = OTHER; note = 2'-MOE thymidine
cgcacttaacaatatcatat

SEQ ID NO: 3855 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphodiester
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-deoxyguanosine 3'-phosphorothioate
  modified_base 15: mod_base = OTHER; note = 2'-deoxyadenosine 3'-phosphorothioate
  modified_base 16..17: mod_base = OTHER; note = 2'-MOE 5-methyl cytidine 3'-phosphodiester
  modified_base 18: mod_base = OTHER; note = 2'-MOE guanosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
gctcatatctaaagaccgca

SEQ ID NO: 3856 - DNA, 20 bp, synthetic construct
  source 1..20: mol_type = other DNA
  modified_base 1: mod_base = OTHER; note = 2'-MOE guanosine 3'-phosphorothioate
  modified_base 2..3: mod_base = OTHER; note = 2'-MOE 5-methyl cytidine 3'-phosphodiester
  modified_base 4..5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 5-methyl 2'-deoxycytidine 3'-phosphorothioate
  modified_base 8..10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE thymidine 3'-phosphodiester
  modified_base 17: mod_base = OTHER; note = 2'-MOE guanosine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE guanosine
gccaaactttaaagatgcag

SEQ ID NO: 3857 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE thymidine 3'-phosphodiester
  modified_base 4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 5-methyl 2'-deoxycytidine 3'-phosphorothioate
  modified_base 7..8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16..17: mod_base = OTHER; note = 2'-MOE adenosine 3'-phosphodiester
  modified_base 18..19: mod_base = OTHER; note = 2'-MOE guanosine 3'-phosphorothioate
  modified_base 20: mod_base = OTHER; note = 2'-MOE guanosine
agttccttcagtctcaaggg

SEQ ID NO: 3858 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphodiester
  modified_base 4: mod_base = OTHER; note = 2'-MOE thymidine 3'-phosphorothioate
  modified_base 5: mod_base = OTHER; note = 2'-MOE adenosine 3'-phosphorothioate
  modified_base 6..8: mod_base = OTHER; note = 5-methyl 2'-deoxycytidine 3'-phosphorothioate
  modified_base 9..11: mod_base = OTHER; note = 2'-deoxythymidine 3'-phosphorothioate
  modified_base 12..13: mod_base = OTHER; note = 5-methyl 2'-deoxycytidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE guanosine 3'-phosphodiester
  modified_base 17: mod_base = OTHER; note = 2'-MOE thymidine 3'-phosphodiester
  modified_base 18: mod_base = OTHER; note = 2'-MOE guanosine 3'-phosphorothioate
  modified_base 19: mod_base = OTHER; note = 2'-MOE adenosine 3'-phosphorothioate
  modified_base 20: mod_base = OTHER; note = 2'-MOE adenosine
gagtaccctttccatgtgaa

SEQ ID NO: 3859 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphodiester
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6..7: mod_base = OTHER; note = 2'-deoxyadenosine 3'-phosphorothioate
  modified_base 8: mod_base = OTHER; note = 5-methyl 2'-deoxycytidine 3'-phosphorothioate
  modified_base 9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13..14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE 5-methyl cytidine 3'-phosphodiester
  modified_base 17: mod_base = OTHER; note = 2'-MOE thymidine 3'-phosphodiester
  modified_base 18: mod_base = OTHER; note = 2'-MOE thymidine 3'-phosphorothioate
  modified_base 19: mod_base = OTHER; note = 2'-MOE 5-methyl cytidine 3'-phosphorothioate
  modified_base 20: mod_base = OTHER; note = 2'-MOE guanosine
ccacaaactcatggacttcg

SEQ ID NO: 3860 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphorothioate
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-deoxyguanosine 3'-phosphorothioate
  modified_base 15: mod_base = OTHER; note = 2'-deoxyadenosine 3'-phosphorothioate
  modified_base 16..17: mod_base = OTHER; note = 2'-MOE 5-methyl cytidine 3'-phosphodiester
  modified_base 18: mod_base = OTHER; note = 2'-MOE guanosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
gctcatatctaaagaccgca

SEQ ID NO: 3861 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE 5-methyl cytidine 3'-phosphorothioate
  modified_base 4..5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 5-methyl 2'-deoxycytidine 3'-phosphorothioate
  modified_base 8..10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE thymidine 3'-phosphodiester
  modified_base 17: mod_base = OTHER; note = 2'-MOE guanosine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE guanosine
gccaaactttaaagatgcag

SEQ ID NO: 3862 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3..4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 5-methyl 2'-deoxycytidine 3'-phosphorothioate
  modified_base 7..8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16..17: mod_base = OTHER; note = 2'-MOE adenosine 3'-phosphodiester
  modified_base 18..19: mod_base = OTHER; note = 2'-MOE guanosine 3'-phosphorothioate
  modified_base 20: mod_base = OTHER; note = 2'-MOE guanosine
agttccttcagtctcaaggg

SEQ ID NO: 3863 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphorothioate
  modified_base 4: mod_base = OTHER; note = 2'-MOE thymidine 3'-phosphorothioate
  modified_base 5: mod_base = OTHER; note = 2'-MOE adenosine 3'-phosphorothioate
  modified_base 6..8: mod_base = OTHER; note = 5-methyl 2'-deoxycytidine 3'-phosphorothioate
  modified_base 9..11: mod_base = OTHER; note = 2'-deoxythymidine 3'-phosphorothioate
  modified_base 12..13: mod_base = OTHER; note = 5-methyl 2'-deoxycytidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE guanosine 3'-phosphodiester
  modified_base 17: mod_base = OTHER; note = 2'-MOE thymidine 3'-phosphodiester
  modified_base 18: mod_base = OTHER; note = 2'-MOE guanosine 3'-phosphorothioate
  modified_base 19: mod_base = OTHER; note = 2'-MOE adenosine 3'-phosphorothioate
  modified_base 20: mod_base = OTHER; note = 2'-MOE adenosine
gagtaccctttccatgtgaa

SEQ ID NO: 3864 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6..7: mod_base = OTHER; note = 2'-deoxyadenosine 3'-phosphorothioate
  modified_base 8: mod_base = OTHER; note = 5-methyl 2'-deoxycytidine 3'-phosphorothioate
  modified_base 9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13..14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE 5-methyl cytidine 3'-phosphodiester
  modified_base 17: mod_base = OTHER; note = 2'-MOE thymidine 3'-phosphodiester
  modified_base 18: mod_base = OTHER; note = 2'-MOE thymidine 3'-phosphorothioate
  modified_base 19: mod_base = OTHER; note = 2'-MOE 5-methyl cytidine 3'-phosphorothioate
  modified_base 20: mod_base = OTHER; note = 2'-MOE guanosine
ccacaaactcatggacttcg

SEQ ID NO: 3865 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphorothioate
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE 5-methyl cytidine 3'-phosphodiester
  modified_base 18: mod_base = OTHER; note = 2'-MOE guanosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
gctcatatctaaagaccgca

SEQ ID NO: 3866 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE 5-methyl cytidine 3'-phosphorothioate
  modified_base 4..5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 5-methyl 2'-deoxycytidine 3'-phosphorothioate
  modified_base 8..10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE thymidine 3'-phosphorothioate
  modified_base 17: mod_base = OTHER; note = 2'-MOE guanosine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE guanosine
gccaaactttaaagatgcag

SEQ ID NO: 3867 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3..4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 5-methyl 2'-deoxycytidine 3'-phosphorothioate
  modified_base 7..8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18..19: mod_base = OTHER; note = 2'-MOE guanosine 3'-phosphorothioate
  modified_base 20: mod_base = OTHER; note = 2'-MOE guanosine
agttccttcagtctcaaggg

SEQ ID NO: 3868 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphorothioate
  modified_base 4: mod_base = OTHER; note = 2'-MOE thymidine 3'-phosphorothioate
  modified_base 5: mod_base = OTHER; note = 2'-MOE adenosine 3'-phosphorothioate
  modified_base 6..8: mod_base = OTHER; note = 5-methyl 2'-deoxycytidine 3'-phosphorothioate
  modified_base 9..11: mod_base = OTHER; note = 2'-deoxythymidine 3'-phosphorothioate
  modified_base 12..13: mod_base = OTHER; note = 5-methyl 2'-deoxycytidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE guanosine 3'-phosphorothioate
  modified_base 17: mod_base = OTHER; note = 2'-MOE thymidine 3'-phosphodiester
  modified_base 18: mod_base = OTHER; note = 2'-MOE guanosine 3'-phosphorothioate
  modified_base 19: mod_base = OTHER; note = 2'-MOE adenosine 3'-phosphorothioate
  modified_base 20: mod_base = OTHER; note = 2'-MOE adenosine
gagtaccctttccatgtgaa

SEQ ID NO: 3869 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6..7: mod_base = OTHER; note = 2'-deoxyadenosine 3'-phosphorothioate
  modified_base 8: mod_base = OTHER; note = 5-methyl 2'-deoxycytidine 3'-phosphorothioate
  modified_base 9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13..14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE thymidine 3'-phosphodiester
  modified_base 18: mod_base = OTHER; note = 2'-MOE thymidine 3'-phosphorothioate
  modified_base 19: mod_base = OTHER; note = 2'-MOE 5-methyl cytidine 3'-phosphorothioate
  modified_base 20: mod_base = OTHER; note = 2'-MOE guanosine
ccacaaactcatggacttcg

SEQ ID NO: 3870 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphorothioate
  modified_base 3: mod_base = OTHER; note = 2'-MOE thymidine 3'-phosphorothioate
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE 5-methyl cytidine 3'-phosphodiester
  modified_base 18: mod_base = OTHER; note = 2'-MOE guanosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
gctcatatctaaagaccgca

SEQ ID NO: 3871 - DNA, 20 bp, synthetic construct
  source 1..20: mol_type = other DNA
  modified_base 1: mod_base = OTHER; note = 2'-MOE guanosine 3'-phosphorothioate
  modified_base 2..3: mod_base = OTHER; note = 2'-MOE 5-methyl cytidine 3'-phosphorothioate
  modified_base 4..5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 5-methyl 2'-deoxycytidine 3'-phosphorothioate
  modified_base 8..10: mod_base = OTHER; note = 2'-deoxythymidine 3'-phosphorothioate
  modified_base 11..13: mod_base = OTHER; note = 2'-deoxyadenosine 3'-phosphorothioate
  modified_base 14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE thymidine 3'-phosphorothioate
  modified_base 17: mod_base = OTHER; note = 2'-MOE guanosine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE guanosine
gccaaactttaaagatgcag

SEQ ID NO: 3872 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphorothioate
  modified_base 3..4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 5-methyl 2'-deoxycytidine 3'-phosphorothioate
  modified_base 7..8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18..19: mod_base = OTHER; note = 2'-MOE guanosine 3'-phosphorothioate
  modified_base 20: mod_base = OTHER; note = 2'-MOE guanosine
agttccttcagtctcaaggg

SEQ ID NO: 3873 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphorothioate
  modified_base 3: mod_base = OTHER; note = 2'-MOE guanosine 3'-phosphorothioate
  modified_base 4: mod_base = OTHER; note = 2'-MOE thymidine 3'-phosphorothioate
  modified_base 5: mod_base = OTHER; note = 2'-MOE adenosine 3'-phosphorothioate
  modified_base 6..8: mod_base = OTHER; note = 5-methyl 2'-deoxycytidine 3'-phosphorothioate
  modified_base 9..11: mod_base = OTHER; note = 2'-deoxythymidine 3'-phosphorothioate
  modified_base 12..13: mod_base = OTHER; note = 5-methyl 2'-deoxycytidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE guanosine 3'-phosphorothioate
  modified_base 17: mod_base = OTHER; note = 2'-MOE thymidine 3'-phosphodiester
  modified_base 18: mod_base = OTHER; note = 2'-MOE guanosine 3'-phosphorothioate
  modified_base 19: mod_base = OTHER; note = 2'-MOE adenosine 3'-phosphorothioate
  modified_base 20: mod_base = OTHER; note = 2'-MOE adenosine
gagtaccctttccatgtgaa

SEQ ID NO: 3874 - DNA, 20 bp, synthetic construct
  source 1..20: mol_type = other DNA
  modified_base 1..2: mod_base = OTHER; note = 2'-MOE 5-methyl cytidine 3'-phosphorothioate
  modified_base 3: mod_base = OTHER; note = 2'-MOE adenosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6..7: mod_base = OTHER; note = 2'-deoxyadenosine 3'-phosphorothioate
  modified_base 8: mod_base = OTHER; note = 5-methyl 2'-deoxycytidine 3'-phosphorothioate
  modified_base 9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13..14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE thymidine 3'-phosphodiester
  modified_base 18: mod_base = OTHER; note = 2'-MOE thymidine 3'-phosphorothioate
  modified_base 19: mod_base = OTHER; note = 2'-MOE 5-methyl cytidine 3'-phosphorothioate
  modified_base 20: mod_base = OTHER; note = 2'-MOE guanosine
ccacaaactcatggacttcg

SEQ ID NO: 3875 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphorothioate
  modified_base 4: mod_base = OTHER; note = 2'-MOE thymidine 3'-phosphorothioate
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxythymidine 3'-phosphorothioate
  modified_base 9..11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14..15: mod_base = OTHER; note = 5-methyl 2'-deoxycytidine 3'-phosphorothioate
  modified_base 16: mod_base = OTHER; note = 2'-MOE guanosine 3'-phosphorothioate
  modified_base 17: mod_base = OTHER; note = 2'-MOE 5-methyl cytidine 3'-phosphodiester
  modified_base 18..19: mod_base = OTHER; note = 2'-MOE adenosine 3'-phosphorothioate
  modified_base 20: mod_base = OTHER; note = 2'-MOE guanosine
tcatatctaaagaccgcaag

SEQ ID NO: 3876 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE thymidine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9: mod_base = OTHER; note = 2'-deoxythymidine 3'-phosphorothioate
  modified_base 10..12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-deoxyadenosine 3'-phosphorothioate
  modified_base 15: mod_base = OTHER; note = 5-methyl 2'-deoxycytidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE guanosine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE adenosine
ctcatatctaaagaccgcaa

SEQ ID NO: 3877 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE 5-methyl cytidine 3'-phosphorothioate
  modified_base 4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11: mod_base = OTHER; note = 2'-deoxythymidine 3'-phosphorothioate
  modified_base 12..14: mod_base = OTHER; note = 2'-deoxyadenosine 3'-phosphorothioate
  modified_base 15: mod_base = OTHER; note = 2'-deoxyguanosine 3'-phosphorothioate
  modified_base 16: mod_base = OTHER; note = 2'-MOE adenosine 3'-phosphorothioate
  modified_base 17: mod_base = OTHER; note = 2'-MOE 5-methyl cytidine 3'-phosphodiester
  modified_base 18: mod_base = OTHER; note = 2'-MOE 5-methyl cytidine 3'-phosphorothioate
  modified_base 19: mod_base = OTHER; note = 2'-MOE guanosine 3'-phosphorothioate
  modified_base 20: mod_base = OTHER; note = 2'-MOE 5-methyl cytidine
tgctcatatctaaagaccgc

SEQ ID NO: 3878 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE thymidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12: mod_base = OTHER; note = 2'-deoxythymidine 3'-phosphorothioate
  modified_base 13..15: mod_base = OTHER; note = 2'-deoxyadenosine 3'-phosphorothioate
  modified_base 16: mod_base = OTHER; note = 2'-MOE guanosine 3'-phosphorothioate
  modified_base 17: mod_base = OTHER; note = 2'-MOE adenosine 3'-phosphodiester
  modified_base 18..19: mod_base = OTHER; note = 2'-MOE 5-methyl cytidine 3'-phosphorothioate
  modified_base 20: mod_base = OTHER; note = 2'-MOE guanosine
ctgctcatatctaaagaccg

SEQ ID NO: 3879 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphorothioate
  modified_base 4: mod_base = OTHER; note = 2'-MOE guanosine 3'-phosphorothioate
  modified_base 5: mod_base = OTHER; note = 2'-MOE 5-methyl cytidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13: mod_base = OTHER; note = 2'-deoxythymidine 3'-phosphorothioate
  modified_base 14..15: mod_base = OTHER; note = 2'-deoxyadenosine 3'-phosphorothioate
  modified_base 16: mod_base = OTHER; note = 2'-MOE adenosine 3'-phosphorothioate
  modified_base 17: mod_base = OTHER; note = 2'-MOE guanosine 3'-phosphodiester
  modified_base 18: mod_base = OTHER; note = 2'-MOE adenosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE 5-methyl cytidine
gctgctcatatctaaagacc

SEQ ID NO: 3880 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE adenosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE thymidine 3'-phosphorothioate
  modified_base 6..7: mod_base = OTHER; note = 2'-deoxythymidine 3'-phosphorothioate
  modified_base 8..10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-deoxyguanosine 3'-phosphorothioate
  modified_base 15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE guanosine 3'-phosphodiester
  modified_base 18..19: mod_base = OTHER; note = 2'-MOE adenosine 3'-phosphorothioate
  modified_base 20: mod_base = OTHER; note = 2'-MOE adenosine
aaactttaaagatgcagaaa

SEQ ID NO: 3881 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3..4: mod_base = OTHER; note = 2'-MOE adenosine 3'-phosphorothioate
  modified_base 5: mod_base = OTHER; note = 2'-MOE 5-methyl cytidine 3'-phosphorothioate
  modified_base 6..8: mod_base = OTHER; note = 2'-deoxythymidine 3'-phosphorothioate
  modified_base 9..11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 2'-deoxyguanosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE guanosine 3'-phosphorothioate
  modified_base 19: mod_base = OTHER; note = 2'-MOE adenosine 3'-phosphorothioate
  modified_base 20: mod_base = OTHER; note = 2'-MOE adenosine
caaactttaaagatgcagaa

SEQ ID NO: 3882 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE 5-methyl cytidine 3'-phosphodiester
  modified_base 3..5: mod_base = OTHER; note = 2'-MOE adenosine 3'-phosphorothioate
  modified_base 6: mod_base = OTHER; note = 5-methyl 2'-deoxycytidine 3'-phosphorothioate
  modified_base 7..9: mod_base = OTHER; note = 2'-deoxythymidine 3'-phosphorothioate
  modified_base 10..12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE guanosine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE guanosine 3'-phosphorothioate
  modified_base 20: mod_base = OTHER; note = 2'-MOE adenosine
ccaaactttaaagatgcaga

SEQ ID NO: 3883 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3..4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6..7: mod_base = OTHER; note = 2'-deoxyadenosine 3'-phosphorothioate
  modified_base 8: mod_base = OTHER; note = 5-methyl 2'-deoxycytidine 3'-phosphorothioate
  modified_base 9..11: mod_base = OTHER; note = 2'-deoxythymidine 3'-phosphorothioate
  modified_base 12..14: mod_base = OTHER; note = 2'-deoxyadenosine 3'-phosphorothioate
  modified_base 15: mod_base = OTHER; note = 2'-deoxyguanosine 3'-phosphorothioate
  modified_base 16: mod_base = OTHER; note = 2'-MOE adenosine 3'-phosphorothioate
  modified_base 17: mod_base = OTHER; note = 2'-MOE thymidine 3'-phosphodiester
  modified_base 18: mod_base = OTHER; note = 2'-MOE guanosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
tgccaaactttaaagatgca

SEQ ID NO: 3884 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4..5: mod_base = OTHER; note = 2'-MOE 5-methyl cytidine 3'-phosphorothioate
  modified_base 6..8: mod_base = OTHER; note = 2'-deoxyadenosine 3'-phosphorothioate
  modified_base 9: mod_base = OTHER; note = 5-methyl 2'-deoxycytidine 3'-phosphorothioate
  modified_base 10..12: mod_base = OTHER; note = 2'-deoxythymidine 3'-phosphorothioate
  modified_base 13..15: mod_base = OTHER; note = 2'-deoxyadenosine 3'-phosphorothioate
  modified_base 16: mod_base = OTHER; note = 2'-MOE guanosine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE guanosine 3'-phosphorothioate
  modified_base 20: mod_base = OTHER; note = 2'-MOE 5-methyl cytidine
ttgccaaactttaaagatgc

SEQ ID NO: 3885 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE thymidine 3'-phosphorothioate
  modified_base 4: mod_base = OTHER; note = 2'-MOE guanosine 3'-phosphorothioate
  modified_base 5: mod_base = OTHER; note = 2'-MOE 5-methyl cytidine 3'-phosphorothioate
  modified_base 6: mod_base = OTHER; note = 5-methyl 2'-deoxycytidine 3'-phosphorothioate
  modified_base 7..9: mod_base = OTHER; note = 2'-deoxyadenosine 3'-phosphorothioate
  modified_base 10: mod_base = OTHER; note = 5-methyl 2'-deoxycytidine 3'-phosphorothioate
  modified_base 11..13: mod_base = OTHER; note = 2'-deoxythymidine 3'-phosphorothioate
  modified_base 14..15: mod_base = OTHER; note = 2'-deoxyadenosine 3'-phosphorothioate
  modified_base 16: mod_base = OTHER; note = 2'-MOE adenosine 3'-phosphorothioate
  modified_base 17: mod_base = OTHER; note = 2'-MOE guanosine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE guanosine
tttgccaaactttaaagatg

SEQ ID NO: 3886 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphorothioate
  modified_base 4..5: mod_base = OTHER; note = 2'-MOE thymidine 3'-phosphorothioate
  modified_base 6..7: mod_base = OTHER; note = 5-methyl 2'-deoxycytidine 3'-phosphorothioate
  modified_base 8..9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxythymidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE adenosine 3'-phosphorothioate
  modified_base 19: mod_base = OTHER; note = 2'-MOE guanosine 3'-phosphorothioate
  modified_base 20: mod_base = OTHER; note = 2'-MOE guanosine
cagttccttcagtctcaagg

SEQ ID NO: 3887 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphorothioate
  modified_base 4: mod_base = OTHER; note = 2'-MOE guanosine 3'-phosphorothioate
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7..8: mod_base = OTHER; note = 5-methyl 2'-deoxycytidine 3'-phosphorothioate
  modified_base 9..10: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE thymidine 3'-phosphorothioate
  modified_base 17: mod_base = OTHER; note = 2'-MOE 5-methyl cytidine 3'-phosphodiester
  modified_base 18..19: mod_base = OTHER; note = 2'-MOE adenosine 3'-phosphorothioate
  modified_base 20: mod_base = OTHER; note = 2'-MOE guanosine
tcagttccttcagtctcaag

SEQ ID NO: 3888 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE guanosine 3'-phosphorothioate
  modified_base 6..7: mod_base = OTHER; note = 2'-deoxythymidine 3'-phosphorothioate
  modified_base 8..9: mod_base = OTHER; note = 5-methyl 2'-deoxycytidine 3'-phosphorothioate
  modified_base 10..11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-deoxyguanosine 3'-phosphorothioate
  modified_base 15: mod_base = OTHER; note = 2'-deoxythymidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE thymidine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE adenosine
ttcagttccttcagtctcaa

SEQ ID NO: 3889 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3..5: mod_base = OTHER; note = 2'-MOE 5-methyl cytidine 3'-phosphorothioate
  modified_base 6..8: mod_base = OTHER; note = 2'-deoxythymidine 3'-phosphorothioate
  modified_base 9..10: mod_base = OTHER; note = 5-methyl 2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-deoxythymidine 3'-phosphorothioate
  modified_base 15: mod_base = OTHER; note = 2'-deoxyguanosine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE thymidine
taccctttccatgtgaacat

SEQ ID NO: 3890 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphorothioate
  modified_base 4..5: mod_base = OTHER; note = 2'-MOE 5-methyl cytidine 3'-phosphorothioate
  modified_base 6: mod_base = OTHER; note = 5-methyl 2'-deoxycytidine 3'-phosphorothioate
  modified_base 7..9: mod_base = OTHER; note = 2'-deoxythymidine 3'-phosphorothioate
  modified_base 10..11: mod_base = OTHER; note = 5-methyl 2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-deoxyguanosine 3'-phosphorothioate
  modified_base 15: mod_base = OTHER; note = 2'-deoxythymidine 3'-phosphorothioate
  modified_base 16: mod_base = OTHER; note = 2'-MOE guanosine 3'-phosphorothioate
  modified_base 17: mod_base = OTHER; note = 2'-MOE adenosine 3'-phosphodiester
  modified_base 18: mod_base = OTHER; note = 2'-MOE adenosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
gtaccctttccatgtgaaca

SEQ ID NO: 3891 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE thymidine 3'-phosphorothioate
  modified_base 4: mod_base = OTHER; note = 2'-MOE adenosine 3'-phosphorothioate
  modified_base 5: mod_base = OTHER; note = 2'-MOE 5-methyl cytidine 3'-phosphorothioate
  modified_base 6..7: mod_base = OTHER; note = 5-methyl 2'-deoxycytidine 3'-phosphorothioate
  modified_base 8..10: mod_base = OTHER; note = 2'-deoxythymidine 3'-phosphorothioate
  modified_base 11..12: mod_base = OTHER; note = 5-methyl 2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 2'-deoxyguanosine 3'-phosphorothioate
  modified_base 16: mod_base = OTHER; note = 2'-MOE thymidine 3'-phosphorothioate
  modified_base 17: mod_base = OTHER; note = 2'-MOE guanosine 3'-phosphodiester
  modified_base 18..19: mod_base = OTHER; note = 2'-MOE adenosine 3'-phosphorothioate
  modified_base 20: mod_base = OTHER; note = 2'-MOE 5-methyl cytidine
agtaccctttccatgtgaac

SEQ ID NO: 3892 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphorothioate
  modified_base 4: mod_base = OTHER; note = 2'-MOE guanosine 3'-phosphorothioate
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7..9: mod_base = OTHER; note = 5-methyl 2'-deoxycytidine 3'-phosphorothioate
  modified_base 10..12: mod_base = OTHER; note = 2'-deoxythymidine 3'-phosphorothioate
  modified_base 13..14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE thymidine 3'-phosphorothioate
  modified_base 17: mod_base = OTHER; note = 2'-MOE guanosine 3'-phosphodiester
  modified_base 18: mod_base = OTHER; note = 2'-MOE thymidine 3'-phosphorothioate
  modified_base 19: mod_base = OTHER; note = 2'-MOE guanosine 3'-phosphorothioate
  modified_base 20: mod_base = OTHER; note = 2'-MOE adenosine
tgagtaccctttccatgtga

SEQ ID NO: 3893 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4: mod_base = OTHER; note = 2'-MOE adenosine 3'-phosphorothioate
  modified_base 5: mod_base = OTHER; note = 2'-MOE guanosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8..10: mod_base = OTHER; note = 5-methyl 2'-deoxycytidine 3'-phosphorothioate
  modified_base 11..13: mod_base = OTHER; note = 2'-deoxythymidine 3'-phosphorothioate
  modified_base 14..15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE thymidine 3'-phosphodiester
  modified_base 18: mod_base = OTHER; note = 2'-MOE guanosine 3'-phosphorothioate
  modified_base 19: mod_base = OTHER; note = 2'-MOE thymidine 3'-phosphorothioate
  modified_base 20: mod_base = OTHER; note = 2'-MOE guanosine
gtgagtaccctttccatgtg

SEQ ID NO: 3894 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE thymidine 3'-phosphorothioate
  modified_base 4: mod_base = OTHER; note = 2'-MOE guanosine 3'-phosphorothioate
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9..11: mod_base = OTHER; note = 5-methyl 2'-deoxycytidine 3'-phosphorothioate
  modified_base 12..14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE guanosine 3'-phosphorothioate
  modified_base 20: mod_base = OTHER; note = 2'-MOE thymidine
tgtgagtaccctttccatgt

SEQ ID NO: 3895 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE adenosine 3'-phosphodiester
  modified_base 5: mod_base = OTHER; note = 2'-MOE thymidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxythymidine 3'-phosphorothioate
  modified_base 8..10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13..14: mod_base = OTHER; note = 5-methyl 2'-deoxycytidine 3'-phosphorothioate
  modified_base 15: mod_base = OTHER; note = 2'-deoxyguanosine 3'-phosphorothioate
  modified_base 16: mod_base = OTHER; note = 2'-MOE 5-methyl cytidine 3'-phosphodiester
  modified_base 17: mod_base = OTHER; note = 2'-MOE adenosine 3'-phosphodiester
  modified_base 18: mod_base = OTHER; note = 2'-MOE adenosine 3'-phosphorothioate
  modified_base 19: mod_base = OTHER; note = 2'-MOE guanosine 3'-phosphorothioate
  modified_base 20: mod_base = OTHER; note = 2'-MOE 5-methyl cytidine
catatctaaagaccgcaagc

SEQ ID NO: 3896 - DNA, 20 bp, synthetic construct
  source 1..20: mol_type = other DNA
  modified_base 1: mod_base = OTHER; note = 2'-MOE guanosine 3'-phosphorothioate
  modified_base 2..3: mod_base = OTHER; note = 2'-MOE thymidine 3'-phosphodiester
  modified_base 4: mod_base = OTHER; note = 2'-MOE 5-methyl cytidine 3'-phosphodiester
  modified_base 5: mod_base = OTHER; note = 2'-MOE 5-methyl cytidine 3'-phosphorothioate
  modified_base 6..7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphodiester
  modified_base 17: mod_base = OTHER; note = 2'-MOE guanosine 3'-phosphodiester
  modified_base 18..19: mod_base = OTHER; note = 2'-MOE guanosine 3'-phosphorothioate
  modified_base 20: mod_base = OTHER; note = 2'-MOE guanosine
gttccttcagtctcaagggg

SEQ ID NO: 3897 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..4: mod_base = OTHER; note = 2'-MOE 5-methyl cytidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxyguanosine 3'-phosphorothioate
  modified_base 10: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14..15: mod_base = OTHER; note = 2'-deoxyadenosine 3'-phosphorothioate
  modified_base 16..17: mod_base = OTHER; note = 2'-MOE guanosine 3'-phosphodiester
  modified_base 18..19: mod_base = OTHER; note = 2'-MOE guanosine 3'-phosphorothioate
  modified_base 20: mod_base = OTHER; note = 2'-MOE guanosine
ttccttcagtctcaaggggg

SEQ ID NO: 3898 - DNA, 20 bp, synthetic construct
  source 1..20: mol_type = other DNA
  modified_base 1: mod_base = OTHER; note = 2'-MOE thymidine 3'-phosphorothioate
  modified_base 2..3: mod_base = OTHER; note = 2'-MOE 5-methyl cytidine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13..14: mod_base = OTHER; note = 2'-deoxyadenosine 3'-phosphorothioate
  modified_base 15: mod_base = OTHER; note = 2'-deoxyguanosine 3'-phosphorothioate
  modified_base 16..17: mod_base = OTHER; note = 2'-MOE guanosine 3'-phosphodiester
  modified_base 18..19: mod_base = OTHER; note = 2'-MOE guanosine 3'-phosphorothioate
  modified_base 20: mod_base = OTHER; note = 2'-MOE adenosine
tccttcagtctcaaggggga

SEQ ID NO: 3899 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphodiester
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..10: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12: mod_base = OTHER; note = 2'-deoxyadenosine 3'-phosphorothioate
  modified_base 13..14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16..17: mod_base = OTHER; note = 2'-MOE guanosine 3'-phosphodiester
  modified_base 18..19: mod_base = OTHER; note = 2'-MOE thymidine 3'-phosphorothioate
  modified_base 20: mod_base = OTHER; note = 2'-MOE adenosine
tcataagtttcattcggtta

SEQ ID NO: 3900 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphorothioate
  modified_base 4: mod_base = OTHER; note = 2'-MOE adenosine 3'-phosphorothioate
  modified_base 5: mod_base = OTHER; note = 2'-MOE thymidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxythymidine 3'-phosphorothioate
  modified_base 8..10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13..14: mod_base = OTHER; note = 5-methyl 2'-deoxycytidine 3'-phosphorothioate
  modified_base 15: mod_base = OTHER; note = 2'-deoxyguanosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE adenosine 3'-phosphorothioate
  modified_base 19: mod_base = OTHER; note = 2'-MOE guanosine 3'-phosphorothioate
  modified_base 20: mod_base = OTHER; note = 2'-MOE 5-methyl cytidine
catatctaaagaccgcaagc

SEQ ID NO: 3901 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE thymidine 3'-phosphorothioate
  modified_base 4..5: mod_base = OTHER; note = 2'-MOE 5-methyl cytidine 3'-phosphorothioate
  modified_base 6..7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphorothioate
  modified_base 17: mod_base = OTHER; note = 2'-MOE guanosine 3'-phosphodiester
  modified_base 18..19: mod_base = OTHER; note = 2'-MOE guanosine 3'-phosphorothioate
  modified_base 20: mod_base = OTHER; note = 2'-MOE guanosine
gttccttcagtctcaagggg

SEQ ID NO: 3902 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..4: mod_base = OTHER; note = 2'-MOE 5-methyl cytidine 3'-phosphorothioate
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxyguanosine 3'-phosphorothioate
  modified_base 10: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14..15: mod_base = OTHER; note = 2'-deoxyadenosine 3'-phosphorothioate
  modified_base 16: mod_base = OTHER; note = 2'-MOE guanosine 3'-phosphorothioate
  modified_base 17: mod_base = OTHER; note = 2'-MOE guanosine 3'-phosphodiester
  modified_base 18..19: mod_base = OTHER; note = 2'-MOE guanosine 3'-phosphorothioate
  modified_base 20: mod_base = OTHER; note = 2'-MOE guanosine
ttccttcagtctcaaggggg

SEQ ID NO: 3903 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2..4: mod_base = OTHER; note = 2'-MOE thymidine 3'-phosphodiester
  modified_base 5: mod_base = OTHER; note = 2'-MOE 5-methyl cytidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxyadenosine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13..14: mod_base = OTHER; note = 5-methyl 2'-deoxycytidine 3'-phosphorothioate
  modified_base 15: mod_base = OTHER; note = 2'-deoxythymidine 3'-phosphorothioate
  modified_base 16: mod_base = OTHER; note = 2'-MOE adenosine 3'-phosphodiester
  modified_base 17: mod_base = OTHER; note = 2'-MOE thymidine 3'-phosphodiester
  modified_base 18: mod_base = OTHER; note = 2'-MOE thymidine 3'-phosphorothioate
  modified_base 19: mod_base = OTHER; note = 2'-MOE adenosine 3'-phosphorothioate
  modified_base 20: mod_base = OTHER; note = 2'-MOE adenosine
ctttctcacatacctattaa

SEQ ID NO: 3904 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE 5-methyl cytidine 3'-phosphodiester
  modified_base 3..4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9: mod_base = OTHER; note = 2'-deoxyadenosine 3'-phosphorothioate
  modified_base 10: mod_base = OTHER; note = 5-methyl 2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 5-methyl 2'-deoxycytidine 3'-phosphorothioate
  modified_base 16: mod_base = OTHER; note = 2'-MOE thymidine 3'-phosphodiester
  modified_base 17: mod_base = OTHER; note = 2'-MOE adenosine 3'-phosphodiester
  modified_base 18..19: mod_base = OTHER; note = 2'-MOE thymidine 3'-phosphorothioate
  modified_base 20: mod_base = OTHER; note = 2'-MOE adenosine
tctttctcacatacctatta

SEQ ID NO: 3905 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE thymidine 3'-phosphodiester
  modified_base 3: mod_base = OTHER; note = 2'-MOE 5-methyl cytidine 3'-phosphodiester
  modified_base 4: mod_base = OTHER; note = 2'-MOE thymidine 3'-phosphodiester
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 5-methyl 2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-deoxyadenosine 3'-phosphorothioate
  modified_base 15: mod_base = OTHER; note = 5-methyl 2'-deoxycytidine 3'-phosphorothioate
  modified_base 16: mod_base = OTHER; note = 2'-MOE 5-methyl cytidine 3'-phosphodiester
  modified_base 17: mod_base = OTHER; note = 2'-MOE thymidine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE thymidine
ctctttctcacatacctatt

SEQ ID NO: 3906 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphodiester
  modified_base 4: mod_base = OTHER; note = 2'-MOE 5-methyl cytidine 3'-phosphodiester
  modified_base 5: mod_base = OTHER; note = 2'-MOE thymidine 3'-phosphorothioate
  modified_base 6..7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11: mod_base = OTHER; note = 2'-deoxyadenosine 3'-phosphorothioate
  modified_base 12: mod_base = OTHER; note = 5-methyl 2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 2'-deoxyadenosine 3'-phosphorothioate
  modified_base 16..17: mod_base = OTHER; note = 2'-MOE 5-methyl cytidine 3'-phosphodiester
  modified_base 18: mod_base = OTHER; note = 2'-MOE thymidine 3'-phosphorothioate
  modified_base 19: mod_base = OTHER; note = 2'-MOE adenosine 3'-phosphorothioate
  modified_base 20: mod_base = OTHER; note = 2'-MOE thymidine
tctctttctcacatacctat

SEQ ID NO: 3907 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE 5-methyl cytidine 3'-phosphorothioate
  modified_base 4..5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 5-methyl 2'-deoxycytidine 3'-phosphorothioate
  modified_base 13..14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18..19: mod_base = OTHER; note = 2'-MOE 5-methyl cytidine 3'-phosphorothioate
  modified_base 20: mod_base = OTHER; note = 2'-MOE adenosine
tgctttcatagcttccacca

SEQ ID NO: 3908 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE thymidine 3'-phosphorothioate
  modified_base 6..7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 5-methyl 2'-deoxycytidine 3'-phosphorothioate
  modified_base 14..15: mod_base = OTHER; note = 2'-deoxythymidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE 5-methyl cytidine
atgctttcatagcttccacc

SEQ ID NO: 3909 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE 5-methyl cytidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxyadenosine 3'-phosphorothioate
  modified_base 12..13: mod_base = OTHER; note = 2'-deoxyguanosine 3'-phosphorothioate
  modified_base 14: mod_base = OTHER; note = 2'-deoxyadenosine 3'-phosphorothioate
  modified_base 15: mod_base = OTHER; note = 5-methyl 2'-deoxycytidine 3'-phosphorothioate
  modified_base 16: mod_base = OTHER; note = 2'-MOE thymidine 3'-phosphorothioate
  modified_base 17: mod_base = OTHER; note = 2'-MOE thymidine 3'-phosphodiester
  modified_base 18..19: mod_base = OTHER; note = 2'-MOE 5-methyl cytidine 3'-phosphorothioate
  modified_base 20: mod_base = OTHER; note = 2'-MOE adenosine
gccactcatgaggacttcca

SEQ ID NO: 3910 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE thymidine 3'-phosphorothioate
  modified_base 4: mod_base = OTHER; note = 2'-MOE guanosine 3'-phosphorothioate
  modified_base 5: mod_base = OTHER; note = 2'-MOE 5-methyl cytidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyadenosine 3'-phosphorothioate
  modified_base 8: mod_base = OTHER; note = 5-methyl 2'-deoxycytidine 3'-phosphorothioate
  modified_base 9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-deoxyadenosine 3'-phosphorothioate
  modified_base 15: mod_base = OTHER; note = 2'-deoxyguanosine 3'-phosphorothioate
  modified_base 16: mod_base = OTHER; note = 2'-MOE guanosine 3'-phosphorothioate
  modified_base 17: mod_base = OTHER; note = 2'-MOE adenosine 3'-phosphodiester
  modified_base 18: mod_base = OTHER; note = 2'-MOE 5-methyl cytidine 3'-phosphorothioate
  modified_base 19: mod_base = OTHER; note = 2'-MOE thymidine 3'-phosphorothioate
  modified_base 20: mod_base = OTHER; note = 2'-MOE thymidine
attgccactcatgaggactt

SEQ ID NO: 3911 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphorothioate
  modified_base 4: mod_base = OTHER; note = 2'-MOE guanosine 3'-phosphorothioate
  modified_base 5: mod_base = OTHER; note = 2'-MOE adenosine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyadenosine 3'-phosphorothioate
  modified_base 8..9: mod_base = OTHER; note = 2'-deoxythymidine 3'-phosphorothioate
  modified_base 10: mod_base = OTHER; note = 2'-deoxyguanosine 3'-phosphorothioate
  modified_base 11..12: mod_base = OTHER; note = 5-methyl 2'-deoxycytidine 3'-phosphorothioate
  modified_base 13: mod_base = OTHER; note = 2'-deoxyadenosine 3'-phosphorothioate
  modified_base 14: mod_base = OTHER; note = 5-methyl 2'-deoxycytidine 3'-phosphorothioate
  modified_base 15: mod_base = OTHER; note = 2'-deoxythymidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE guanosine 3'-phosphorothioate
  modified_base 20: mod_base = OTHER; note = 2'-MOE adenosine
cctgacattgccactcatga

SEQ ID NO: 3912 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE thymidine 3'-phosphorothioate
  modified_base 6..7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9..11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18: mod_base = OTHER; note = 2'-MOE adenosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
tgcatttctttatgaaaaca

SEQ ID NO: 3913 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphorothioate
  modified_base 4: mod_base = OTHER; note = 2'-MOE adenosine 3'-phosphorothioate
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8..10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 2'-deoxyguanosine 3'-phosphorothioate
  modified_base 15: mod_base = OTHER; note = 5-methyl 2'-deoxycytidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE guanosine 3'-phosphorothioate
  modified_base 20: mod_base = OTHER; note = 2'-MOE 5-methyl cytidine
gagattatttagtgcccagc

SEQ ID NO: 3914 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphorothioate
  modified_base 4..5: mod_base = OTHER; note = 2'-MOE thymidine 3'-phosphorothioate
  modified_base 6..7: mod_base = OTHER; note = 5-methyl 2'-deoxycytidine 3'-phosphorothioate
  modified_base 8..11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE guanosine 3'-phosphorothioate
  modified_base 20: mod_base = OTHER; note = 2'-MOE thymidine
gtattccttttgataacagt

SEQ ID NO: 3915 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3..4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7..8: mod_base = OTHER; note = 2'-deoxyguanosine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13..14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE thymidine 3'-phosphodiester
  modified_base 18..19: mod_base = OTHER; note = 2'-MOE thymidine 3'-phosphorothioate
  modified_base 20: mod_base = OTHER; note = 2'-MOE thymidine
cattcaggtgtattcctttt

SEQ ID NO: 3916 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE 5-methyl cytidine 3'-phosphorothioate
  modified_base 6..8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12..13: mod_base = OTHER; note = 5-methyl 2'-deoxycytidine 3'-phosphorothioate
  modified_base 14: mod_base = OTHER; note = 2'-deoxyadenosine 3'-phosphorothioate
  modified_base 15: mod_base = OTHER; note = 5-methyl 2'-deoxycytidine 3'-phosphorothioate
  modified_base 16: mod_base = OTHER; note = 2'-MOE thymidine 3'-phosphorothioate
  modified_base 17: mod_base = OTHER; note = 2'-MOE thymidine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE guanosine
gccactttcagccacttcag

SEQ ID NO: 3917 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE 5-methyl cytidine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7..9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 5-methyl 2'-deoxycytidine 3'-phosphorothioate
  modified_base 13..14: mod_base = OTHER; note = 2'-deoxythymidine 3'-phosphorothioate
  modified_base 15: mod_base = OTHER; note = 2'-deoxyadenosine 3'-phosphorothioate
  modified_base 16: mod_base = OTHER; note = 2'-MOE thymidine 3'-phosphorothioate
  modified_base 17: mod_base = OTHER; note = 2'-MOE guanosine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE guanosine
accatatttagcttatgatg

SEQ ID NO: 3918 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3..4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8..10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxyguanosine 3'-phosphorothioate
  modified_base 13: mod_base = OTHER; note = 5-methyl 2'-deoxycytidine 3'-phosphorothioate
  modified_base 14..15: mod_base = OTHER; note = 2'-deoxythymidine 3'-phosphorothioate
  modified_base 16: mod_base = OTHER; note = 2'-MOE adenosine 3'-phosphorothioate
  modified_base 17: mod_base = OTHER; note = 2'-MOE thymidine 3'-phosphodiester
  modified_base 18: mod_base = OTHER; note = 2'-MOE guanosine 3'-phosphorothioate
  modified_base 19: mod_base = OTHER; note = 2'-MOE adenosine 3'-phosphorothioate
  modified_base 20: mod_base = OTHER; note = 2'-MOE thymidine
aaccatatttagcttatgat

SEQ ID NO: 3919 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-deoxyguanosine 3'-phosphorothioate
  modified_base 16: mod_base = OTHER; note = 2'-MOE thymidine 3'-phosphorothioate
  modified_base 17: mod_base = OTHER; note = 2'-MOE adenosine 3'-phosphodiester
  modified_base 18: mod_base = OTHER; note = 2'-MOE guanosine 3'-phosphorothioate
  modified_base 19: mod_base = OTHER; note = 2'-MOE thymidine 3'-phosphorothioate
  modified_base 20: mod_base = OTHER; note = 2'-MOE adenosine
tgcatagtctgtaggtagta

SEQ ID NO: 3920 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4..5: mod_base = OTHER; note = 2'-MOE thymidine 3'-phosphorothioate
  modified_base 6: mod_base = OTHER; note = 2'-deoxyadenosine 3'-phosphorothioate
  modified_base 7..8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE 5-methyl cytidine 3'-phosphorothioate
  modified_base 19: mod_base = OTHER; note = 2'-MOE guanosine 3'-phosphorothioate
  modified_base 20: mod_base = OTHER; note = 2'-MOE 5-methyl cytidine
ctgttattctgatcacacgc

SEQ ID NO: 3921 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE thymidine 3'-phosphorothioate
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6..7: mod_base = OTHER; note = 5-methyl 2'-deoxycytidine 3'-phosphorothioate
  modified_base 8..10: mod_base = OTHER; note = 2'-deoxythymidine 3'-phosphorothioate
  modified_base 11..13: mod_base = OTHER; note = 5-methyl 2'-deoxycytidine 3'-phosphorothioate
  modified_base 14..15: mod_base = OTHER; note = 2'-deoxyadenosine 3'-phosphorothioate
  modified_base 16: mod_base = OTHER; note = 2'-MOE thymidine 3'-phosphorothioate
  modified_base 17: mod_base = OTHER; note = 2'-MOE guanosine 3'-phosphodiester
  modified_base 18: mod_base = OTHER; note = 2'-MOE 5-methyl cytidine 3'-phosphorothioate
  modified_base 19: mod_base = OTHER; note = 2'-MOE thymidine 3'-phosphorothioate
  modified_base 20: mod_base = OTHER; note = 2'-MOE thymidine
tgtcacctttcccaatgctt

SEQ ID NO: 3922 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7..8: mod_base = OTHER; note = 5-methyl 2'-deoxycytidine 3'-phosphorothioate
  modified_base 9..11: mod_base = OTHER; note = 2'-deoxythymidine 3'-phosphorothioate
  modified_base 12..14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphorothioate
  modified_base 17: mod_base = OTHER; note = 2'-MOE thymidine 3'-phosphodiester
  modified_base 18: mod_base = OTHER; note = 2'-MOE guanosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE thymidine
ctgtcacctttcccaatgct

SEQ ID NO: 3923 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphorothioate
  modified_base 4: mod_base = OTHER; note = 2'-MOE guanosine 3'-phosphorothioate
  modified_base 5: mod_base = OTHER; note = 2'-MOE thymidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyadenosine 3'-phosphorothioate
  modified_base 8..9: mod_base = OTHER; note = 5-methyl 2'-deoxycytidine 3'-phosphorothioate
  modified_base 10..12: mod_base = OTHER; note = 2'-deoxythymidine 3'-phosphorothioate
  modified_base 13..15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE guanosine 3'-phosphorothioate
  modified_base 20: mod_base = OTHER; note = 2'-MOE 5-methyl cytidine
gctgtcacctttcccaatgc

SEQ ID NO: 3924 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE guanosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9: mod_base = OTHER; note = 2'-deoxyadenosine 3'-phosphorothioate
  modified_base 10..11: mod_base = OTHER; note = 5-methyl 2'-deoxycytidine 3'-phosphorothioate
  modified_base 12..14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE 5-methyl cytidine 3'-phosphodiester
  modified_base 18..19: mod_base = OTHER; note = 2'-MOE adenosine 3'-phosphorothioate
  modified_base 20: mod_base = OTHER; note = 2'-MOE thymidine
tggctgtcacctttcccaat

SEQ ID NO: 3925 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE thymidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9..11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE adenosine 3'-phosphorothioate
  modified_base 20: mod_base = OTHER; note = 2'-MOE 5-methyl cytidine
ctgctctctttctcacatac

SEQ ID NO: 3926 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4: mod_base = OTHER; note = 2'-MOE thymidine 3'-phosphorothioate
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 5-methyl 2'-deoxycytidine 3'-phosphorothioate
  modified_base 10..11: mod_base = OTHER; note = 2'-deoxyguanosine 3'-phosphorothioate
  modified_base 12: mod_base = OTHER; note = 5-methyl 2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE thymidine 3'-phosphorothioate
  modified_base 17: mod_base = OTHER; note = 2'-MOE 5-methyl cytidine 3'-phosphodiester
  modified_base 18..19: mod_base = OTHER; note = 2'-MOE guanosine 3'-phosphorothioate
  modified_base 20: mod_base = OTHER; note = 2'-MOE thymidine
ctgtaatacggcatctcggt

SEQ ID NO: 3927 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphorothioate
  modified_base 4: mod_base = OTHER; note = 2'-MOE adenosine 3'-phosphorothioate
  modified_base 5: mod_base = OTHER; note = 2'-MOE thymidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9..11: mod_base = OTHER; note = 2'-deoxythymidine 3'-phosphorothioate
  modified_base 12..13: mod_base = OTHER; note = 5-methyl 2'-deoxycytidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE thymidine 3'-phosphorothioate
  modified_base 17: mod_base = OTHER; note = 2'-MOE guanosine 3'-phosphodiester
  modified_base 18..19: mod_base = OTHER; note = 2'-MOE 5-methyl cytidine 3'-phosphorothioate
  modified_base 20: mod_base = OTHER; note = 2'-MOE thymidine
cagatctgtttccattgcct

SEQ ID NO: 3928 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE guanosine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE 5-methyl cytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8..10: mod_base = OTHER; note = 2'-deoxyadenosine 3'-phosphorothioate
  modified_base 11: mod_base = OTHER; note = 5-methyl 2'-deoxycytidine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE 5-methyl cytidine 3'-phosphorothioate
  modified_base 19: mod_base = OTHER; note = 2'-MOE thymidine 3'-phosphorothioate
  modified_base 20: mod_base = OTHER; note = 2'-MOE thymidine
ggcactgaaactctccactt

SEQ ID NO: 3929 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3..4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 5-methyl 2'-deoxycytidine 3'-phosphorothioate
  modified_base 11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13: mod_base = OTHER; note = 2'-deoxythymidine 3'-phosphorothioate
  modified_base 14: mod_base = OTHER; note = 2'-deoxyadenosine 3'-phosphorothioate
  modified_base 15: mod_base = OTHER; note = 2'-deoxyguanosine 3'-phosphorothioate
  modified_base 16: mod_base = OTHER; note = 2'-MOE adenosine 3'-phosphorothioate
  modified_base 17: mod_base = OTHER; note = 2'-MOE 5-methyl cytidine 3'-phosphodiester
  modified_base 18: mod_base = OTHER; note = 2'-MOE 5-methyl cytidine 3'-phosphodiester
  modified_base 19: mod_base = OTHER; note = 2'-MOE adenosine 3'-phosphorothioate
  modified_base 20: mod_base = OTHER; note = 2'-MOE thymidine
gtttctctactctagaccat

SEQ ID NO: 3930 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphorothioate
  modified_base 4..5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 5-methyl 2'-deoxycytidine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxythymidine 3'-phosphorothioate
  modified_base 16: mod_base = OTHER; note = 2'-MOE adenosine 3'-phosphorothioate
  modified_base 17: mod_base = OTHER; note = 2'-MOE guanosine 3'-phosphodiester
  modified_base 18: mod_base = OTHER; note = 2'-MOE adenosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE 5-methyl cytidine
cagtttctctactctagacc

SEQ ID NO: 3931 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4: mod_base = OTHER; note = 2'-MOE thymidine 3'-phosphorothioate
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10..11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14..15: mod_base = OTHER; note = 5-methyl 2'-deoxycytidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE guanosine 3'-phosphorothioate
  modified_base 19: mod_base = OTHER; note = 2'-MOE adenosine 3'-phosphorothioate
  modified_base 20: mod_base = OTHER; note = 2'-MOE guanosine
atgtatctcttaacccagag

SEQ ID NO: 3932 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphorothioate
  modified_base 4: mod_base = OTHER; note = 2'-MOE guanosine 3'-phosphorothioate
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11..12: mod_base = OTHER; note = 2'-deoxythymidine 3'-phosphorothioate
  modified_base 13..14: mod_base = OTHER; note = 2'-deoxyadenosine 3'-phosphorothioate
  modified_base 15: mod_base = OTHER; note = 5-methyl 2'-deoxycytidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE guanosine 3'-phosphorothioate
  modified_base 20: mod_base = OTHER; note = 2'-MOE adenosine
catgtatctcttaacccaga

SEQ ID NO: 3933 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3..5: mod_base = OTHER; note = 2'-MOE thymidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE thymidine 3'-phosphorothioate
  modified_base 17: mod_base = OTHER; note = 2'-MOE thymidine 3'-phosphodiester
  modified_base 18..19: mod_base = OTHER; note = 2'-MOE adenosine 3'-phosphorothioate
  modified_base 20: mod_base = OTHER; note = 2'-MOE 5-methyl cytidine
gttttcatgtatctcttaac

SEQ ID NO: 3934 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3..5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxythymidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE thymidine 3'-phosphodiester
  modified_base 18: mod_base = OTHER; note = 2'-MOE thymidine 3'-phosphorothioate
  modified_base 19: mod_base = OTHER; note = 2'-MOE adenosine 3'-phosphorothioate
  modified_base 20: mod_base = OTHER; note = 2'-MOE adenosine
tgttttcatgtatctcttaa

SEQ ID NO: 3935 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4..5: mod_base = OTHER; note = 2'-MOE thymidine 3'-phosphorothioate
  modified_base 6..7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE thymidine 3'-phosphorothioate
  modified_base 17: mod_base = OTHER; note = 2'-MOE 5-methyl cytidine 3'-phosphodiester
  modified_base 18..19: mod_base = OTHER; note = 2'-MOE thymidine 3'-phosphorothioate
  modified_base 20: mod_base = OTHER; note = 2'-MOE adenosine
ctgttttcatgtatctctta

SEQ ID NO: 3936 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE guanosine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7..11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 5-methyl 2'-deoxycytidine 3'-phosphorothioate
  modified_base 14: mod_base = OTHER; note = 2'-deoxyguanosine 3'-phosphorothioate
  modified_base 15: mod_base = OTHER; note = 5-methyl 2'-deoxycytidine 3'-phosphorothioate
  modified_base 16: mod_base = OTHER; note = 2'-MOE thymidine 3'-phosphorothioate
  modified_base 17: mod_base = OTHER; note = 2'-MOE 5-methyl cytidine 3'-phosphodiester
  modified_base 18: mod_base = OTHER; note = 2'-MOE 5-methyl cytidine 3'-phosphorothioate
  modified_base 19: mod_base = OTHER; note = 2'-MOE guanosine 3'-phosphorothioate
  modified_base 20: mod_base = OTHER; note = 2'-MOE adenosine
ggcacatttttacgctccga

SEQ ID NO: 3937 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE thymidine 3'-phosphodiester
  modified_base 3..4: mod_base = OTHER; note = 2'-MOE guanosine 3'-phosphorothioate
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7..11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13: mod_base = OTHER; note = 2'-deoxythymidine 3'-phosphorothioate
  modified_base 14: mod_base = OTHER; note = 2'-deoxyadenosine 3'-phosphorothioate
  modified_base 15: mod_base = OTHER; note = 2'-deoxyguanosine 3'-phosphorothioate
  modified_base 16: mod_base = OTHER; note = 2'-MOE guanosine 3'-phosphorothioate
  modified_base 17: mod_base = OTHER; note = 2'-MOE adenosine 3'-phosphodiester
  modified_base 18: mod_base = OTHER; note = 2'-MOE guanosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE thymidine
ctggaatttttctaggagct

SEQ ID NO: 3938 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphorothioate
  modified_base 4: mod_base = OTHER; note = 2'-MOE thymidine 3'-phosphorothioate
  modified_base 5: mod_base = OTHER; note = 2'-MOE guanosine 3'-phosphorothioate
  modified_base 6: mod_base = OTHER; note = 2'-deoxythymidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12..13: mod_base = OTHER; note = 2'-deoxythymidine 3'-phosphorothioate
  modified_base 14..15: mod_base = OTHER; note = 2'-deoxyadenosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE 5-methyl cytidine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE guanosine
tcatgtatctcttaacccag

SEQ ID NO: 3939 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3..4: mod_base = OTHER; note = 2'-MOE 5-methyl cytidine 3'-phosphorothioate
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7..8: mod_base = OTHER; note = 2'-deoxyadenosine 3'-phosphorothioate
  modified_base 9: mod_base = OTHER; note = 2'-deoxyguanosine 3'-phosphorothioate
  modified_base 10..11: mod_base = OTHER; note = 2'-deoxythymidine 3'-phosphorothioate
  modified_base 12: mod_base = OTHER; note = 2'-deoxyadenosine 3'-phosphorothioate
  modified_base 13..14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE guanosine 3'-phosphorothioate
  modified_base 17: mod_base = OTHER; note = 2'-MOE guanosine 3'-phosphodiester
  modified_base 18: mod_base = OTHER; note = 2'-MOE adenosine 3'-phosphorothioate
  modified_base 19: mod_base = OTHER; note = 2'-MOE guanosine 3'-phosphorothioate
  modified_base 20: mod_base = OTHER; note = 2'-MOE adenosine
tacctgaagttaggaggaga

SEQ ID NO: 3940 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE 5-methyl cytidine 3'-phosphodiester
  modified_base 3: mod_base = OTHER; note = 2'-MOE 5-methyl cytidine 3'-phosphorothioate
  modified_base 4: mod_base = OTHER; note = 2'-MOE thymidine 3'-phosphorothioate
  modified_base 5: mod_base = OTHER; note = 2'-MOE guanosine 3'-phosphorothioate
  modified_base 6..7: mod_base = OTHER; note = 2'-deoxyadenosine 3'-phosphorothioate
  modified_base 8: mod_base = OTHER; note = 2'-deoxyguanosine 3'-phosphorothioate
  modified_base 9..10: mod_base = OTHER; note = 2'-deoxythymidine 3'-phosphorothioate
  modified_base 11: mod_base = OTHER; note = 2'-deoxyadenosine 3'-phosphorothioate
  modified_base 12..13: mod_base = OTHER; note = 2'-deoxyguanosine 3'-phosphorothioate
  modified_base 14: mod_base = OTHER; note = 2'-deoxyadenosine 3'-phosphorothioate
  modified_base 15: mod_base = OTHER; note = 2'-deoxyguanosine 3'-phosphorothioate
  modified_base 16: mod_base = OTHER; note = 2'-MOE guanosine 3'-phosphorothioate
  modified_base 17: mod_base = OTHER; note = 2'-MOE adenosine 3'-phosphodiester
  modified_base 18: mod_base = OTHER; note = 2'-MOE guanosine 3'-phosphorothioate
  modified_base 19: mod_base = OTHER; note = 2'-MOE adenosine 3'-phosphorothioate
  modified_base 20: mod_base = OTHER; note = 2'-MOE thymidine
acctgaagttaggaggagat

SEQ ID NO: 3941 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7..8: mod_base = OTHER; note = 2'-deoxyadenosine 3'-phosphorothioate
  modified_base 9: mod_base = OTHER; note = 5-methyl 2'-deoxycytidine 3'-phosphorothioate
  modified_base 10..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE thymidine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE adenosine
gcacttaacaatatcatata

SEQ ID NO: 3942 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE 5-methyl cytidine 3'-phosphorothioate
  modified_base 4: mod_base = OTHER; note = 2'-MOE guanosine 3'-phosphorothioate
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7: mod_base = OTHER; note = 5-methyl 2'-deoxycytidine 3'-phosphorothioate
  modified_base 8..9: mod_base = OTHER; note = 2'-deoxythymidine 3'-phosphorothioate
  modified_base 10..11: mod_base = OTHER; note = 2'-deoxyadenosine 3'-phosphorothioate
  modified_base 12: mod_base = OTHER; note = 5-methyl 2'-deoxycytidine 3'-phosphorothioate
  modified_base 13..14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE adenosine 3'-phosphorothioate
  modified_base 17: mod_base = OTHER; note = 2'-MOE thymidine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE thymidine
aacgcacttaacaatatcat

SEQ ID NO: 3943 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE adenosine 3'-phosphodiester
  modified_base 3: mod_base = OTHER; note = 2'-MOE adenosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE guanosine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyadenosine 3'-phosphorothioate
  modified_base 8: mod_base = OTHER; note = 5-methyl 2'-deoxycytidine 3'-phosphorothioate
  modified_base 9..10: mod_base = OTHER; note = 2'-deoxythymidine 3'-phosphorothioate
  modified_base 11..12: mod_base = OTHER; note = 2'-deoxyadenosine 3'-phosphorothioate
  modified_base 13: mod_base = OTHER; note = 5-methyl 2'-deoxycytidine 3'-phosphorothioate
  modified_base 14..15: mod_base = OTHER; note = 2'-deoxyadenosine 3'-phosphorothioate
  modified_base 16: mod_base = OTHER; note = 2'-MOE thymidine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
taacgcacttaacaatatca

SEQ ID NO: 3944 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE thymidine 3'-phosphorothioate
  modified_base 4..5: mod_base = OTHER; note = 2'-MOE adenosine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyguanosine 3'-phosphorothioate
  modified_base 8: mod_base = OTHER; note = 5-methyl 2'-deoxycytidine 3'-phosphorothioate
  modified_base 9: mod_base = OTHER; note = 2'-deoxyadenosine 3'-phosphorothioate
  modified_base 10: mod_base = OTHER; note = 5-methyl 2'-deoxycytidine 3'-phosphorothioate
  modified_base 11..12: mod_base = OTHER; note = 2'-deoxythymidine 3'-phosphorothioate
  modified_base 13..14: mod_base = OTHER; note = 2'-deoxyadenosine 3'-phosphorothioate
  modified_base 15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE adenosine 3'-phosphorothioate
  modified_base 20: mod_base = OTHER; note = 2'-MOE thymidine
gttaacgcacttaacaatat

SEQ ID NO: 3945 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE 5-methyl cytidine 3'-phosphodiester
  modified_base 3: mod_base = OTHER; note = 2'-MOE guanosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6: mod_base = OTHER; note = 5-methyl 2'-deoxycytidine 3'-phosphorothioate
  modified_base 7..8: mod_base = OTHER; note = 2'-deoxythymidine 3'-phosphorothioate
  modified_base 9..10: mod_base = OTHER; note = 2'-deoxyadenosine 3'-phosphorothioate
  modified_base 11: mod_base = OTHER; note = 5-methyl 2'-deoxycytidine 3'-phosphorothioate
  modified_base 12..13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 2'-deoxyadenosine 3'-phosphorothioate
  modified_base 16: mod_base = OTHER; note = 2'-MOE thymidine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE adenosine
acgcacttaacaatatcata

SEQ ID NO: 3946 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE 5-methyl cytidine 3'-phosphorothioate
  modified_base 4..5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxyadenosine 3'-phosphorothioate
  modified_base 9..10: mod_base = OTHER; note = 2'-deoxythymidine 3'-phosphorothioate
  modified_base 11..12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 2'-deoxyadenosine 3'-phosphorothioate
  modified_base 15: mod_base = OTHER; note = 2'-deoxyguanosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE adenosine 3'-phosphorothioate
  modified_base 20: mod_base = OTHER; note = 2'-MOE 5-methyl cytidine
agcaatcattggtagcatac

SEQ ID NO: 3947 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE 5-methyl cytidine 3'-phosphodiester
  modified_base 3..4: mod_base = OTHER; note = 2'-MOE 5-methyl cytidine 3'-phosphorothioate
  modified_base 5: mod_base = OTHER; note = 2'-MOE thymidine 3'-phosphorothioate
  modified_base 6..7: mod_base = OTHER; note = 2'-deoxythymidine 3'-phosphorothioate
  modified_base 8..9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 2'-deoxyguanosine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE thymidine
accctttccatgtgaacatt

SEQ ID NO: 3948 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4: mod_base = OTHER; note = 2'-MOE thymidine 3'-phosphorothioate
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10..12: mod_base = OTHER; note = 5-methyl 2'-deoxycytidine 3'-phosphorothioate
  modified_base 13..15: mod_base = OTHER; note = 2'-deoxythymidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE guanosine
atgtgagtaccctttccatg

SEQ ID NO: 3949 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE 5-methyl cytidine 3'-phosphodiester
  modified_base 3..4: mod_base = OTHER; note = 2'-MOE thymidine 3'-phosphorothioate
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 5-methyl 2'-deoxycytidine 3'-phosphorothioate
  modified_base 8..9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE adenosine 3'-phosphorothioate
  modified_base 17: mod_base = OTHER; note = 2'-MOE thymidine 3'-phosphodiester
  modified_base 18..19: mod_base = OTHER; note = 2'-MOE adenosine 3'-phosphorothioate
  modified_base 20: mod_base = OTHER; note = 2'-MOE thymidine
acttaacaatatcatataat

SEQ ID NO: 3950 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE 5-methyl cytidine 3'-phosphorothioate
  modified_base 4..5: mod_base = OTHER; note = 2'-MOE thymidine 3'-phosphorothioate
  modified_base 6..7: mod_base = OTHER; note = 2'-deoxyadenosine 3'-phosphorothioate
  modified_base 8: mod_base = OTHER; note = 5-methyl 2'-deoxycytidine 3'-phosphorothioate
  modified_base 9..10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE thymidine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE adenosine 3'-phosphorothioate
  modified_base 20: mod_base = OTHER; note = 2'-MOE adenosine
cacttaacaatatcatataa

SEQ ID NO: 3951 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE 5-methyl cytidine 3'-phosphorothioate
  modified_base 6: mod_base = OTHER; note = 5-methyl 2'-deoxycytidine 3'-phosphorothioate
  modified_base 7..9: mod_base = OTHER; note = 2'-deoxythymidine 3'-phosphorothioate
  modified_base 10..12: mod_base = OTHER; note = 5-methyl 2'-deoxycytidine 3'-phosphorothioate
  modified_base 13..14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE guanosine 3'-phosphorothioate
  modified_base 17: mod_base = OTHER; note = 2'-MOE 5-methyl cytidine 3'-phosphodiester
  modified_base 18..19: mod_base = OTHER; note = 2'-MOE thymidine 3'-phosphorothioate
  modified_base 20: mod_base = OTHER; note = 2'-MOE adenosine
gtcacctttcccaatgctta

SEQ ID NO: 3952 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE 5-methyl cytidine 3'-phosphorothioate
  modified_base 4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9: mod_base = OTHER; note = 2'-deoxyadenosine 3'-phosphorothioate
  modified_base 10..11: mod_base = OTHER; note = 2'-deoxyguanosine 3'-phosphorothioate
  modified_base 12: mod_base = OTHER; note = 2'-deoxyadenosine 3'-phosphorothioate
  modified_base 13: mod_base = OTHER; note = 5-methyl 2'-deoxycytidine 3'-phosphorothioate
  modified_base 14..15: mod_base = OTHER; note = 2'-deoxythymidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
cactcatgaggacttccaca

SEQ ID NO: 3953 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE thymidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 2'-deoxyadenosine 3'-phosphorothioate
  modified_base 11..12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = 5-methyl 2'-deoxycytidine 3'-phosphorothioate
  modified_base 15: mod_base = OTHER; note = 2'-deoxythymidine 3'-phosphorothioate
  modified_base 16: mod_base = OTHER; note = 2'-MOE thymidine 3'-phosphorothioate
  modified_base 17: mod_base = OTHER; note = 2'-MOE 5-methyl cytidine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE 5-methyl cytidine
ccactcatgaggacttccac

SEQ ID NO: 3954 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphorothioate
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 2'-deoxyadenosine 3'-phosphorothioate
  modified_base 9..10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 5-methyl 2'-deoxycytidine 3'-phosphorothioate
  modified_base 13..14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE thymidine
actcatgaggacttccacat

SEQ ID NO: 3955 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE 5-methyl cytidine 3'-phosphorothioate
  modified_base 4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8..10: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxyadenosine 3'-phosphorothioate
  modified_base 15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE thymidine 3'-phosphodiester
  modified_base 18: mod_base = OTHER; note = 2'-MOE adenosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE 5-methyl cytidine
tgctctctttctcacatacc

SEQ ID NO: 3956 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE thymidine 3'-phosphodiester
  modified_base 3..4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7: mod_base = OTHER; note = 5-methyl 2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13..15: mod_base = OTHER; note = 2'-deoxyguanosine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE guanosine 3'-phosphorothioate
  modified_base 20: mod_base = OTHER; note = 2'-MOE 5-methyl cytidine
ctttcactcatagggaatgc

SEQ ID NO: 3957 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE 5-methyl cytidine 3'-phosphorothioate
  modified_base 4: mod_base = OTHER; note = 2'-MOE thymidine 3'-phosphorothioate
  modified_base 5: mod_base = OTHER; note = 2'-MOE guanosine 3'-phosphorothioate
  modified_base 6: mod_base = OTHER; note = 5-methyl 2'-deoxycytidine 3'-phosphorothioate
  modified_base 7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11..13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxythymidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE thymidine
gactgctctctttctcacat

SEQ ID NO: 3958 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphorothioate
  modified_base 4: mod_base = OTHER; note = 2'-MOE guanosine 3'-phosphorothioate
  modified_base 5: mod_base = OTHER; note = 2'-MOE 5-methyl cytidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10..12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE adenosine
actgctctctttctcacata

SEQ ID NO: 3959 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphorothioate
  modified_base 4..5: mod_base = OTHER; note = 2'-MOE 5-methyl cytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10: mod_base = OTHER; note = 2'-deoxyguanosine 3'-phosphorothioate
  modified_base 11..12: mod_base = OTHER; note = 2'-deoxythymidine 3'-phosphorothioate
  modified_base 13: mod_base = OTHER; note = 2'-deoxyadenosine 3'-phosphorothioate
  modified_base 14..15: mod_base = OTHER; note = 2'-deoxyguanosine 3'-phosphorothioate
  modified_base 16: mod_base = OTHER; note = 2'-MOE adenosine 3'-phosphorothioate
  modified_base 17: mod_base = OTHER; note = 2'-MOE guanosine 3'-phosphodiester
  modified_base 18: mod_base = OTHER; note = 2'-MOE guanosine 3'-phosphorothioate
  modified_base 19: mod_base = OTHER; note = 2'-MOE adenosine 3'-phosphorothioate
  modified_base 20: mod_base = OTHER; note = 2'-MOE guanosine
ttacctgaagttaggaggag

SEQ ID NO: 3960 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3..5: mod_base = OTHER; note = 2'-MOE thymidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyadenosine 3'-phosphorothioate
  modified_base 8..9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11..12: mod_base = OTHER; note = 2'-deoxyguanosine 3'-phosphorothioate
  modified_base 13..14: mod_base = OTHER; note = 2'-deoxythymidine 3'-phosphorothioate
  modified_base 15: mod_base = OTHER; note = 2'-deoxyadenosine 3'-phosphorothioate
  modified_base 16: mod_base = OTHER; note = 2'-MOE thymidine 3'-phosphorothioate
  modified_base 17: mod_base = OTHER; note = 2'-MOE adenosine 3'-phosphodiester
  modified_base 18: mod_base = OTHER; note = 2'-MOE adenosine 3'-phosphorothioate
  modified_base 19: mod_base = OTHER; note = 2'-MOE guanosine 3'-phosphorothioate
  modified_base 20: mod_base = OTHER; note = 2'-MOE guanosine
agtttcattcggttataagg

SEQ ID NO: 3961 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3..4: mod_base = OTHER; note = 2'-MOE guanosine 3'-phosphorothioate
  modified_base 5: mod_base = OTHER; note = 2'-MOE adenosine 3'-phosphorothioate
  modified_base 6: mod_base = OTHER; note = 5-methyl 2'-deoxycytidine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9: mod_base = OTHER; note = 5-methyl 2'-deoxycytidine 3'-phosphorothioate
  modified_base 10: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14..15: mod_base = OTHER; note = 2'-deoxythymidine 3'-phosphorothioate
  modified_base 16: mod_base = OTHER; note = 2'-MOE thymidine 3'-phosphorothioate
  modified_base 17: mod_base = OTHER; note = 2'-MOE 5-methyl cytidine 3'-phosphodiester
  modified_base 18: mod_base = OTHER; note = 2'-MOE thymidine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
tgggactgctctctttctca

SEQ ID NO: 3962 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 5-methyl 2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 5-methyl 2'-deoxycytidine 3'-phosphorothioate
  modified_base 11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxythymidine 3'-phosphorothioate
  modified_base 16: mod_base = OTHER; note = 2'-MOE thymidine 3'-phosphorothioate
  modified_base 17: mod_base = OTHER; note = 2'-MOE thymidine 3'-phosphodiester
  modified_base 18: mod_base = OTHER; note = 2'-MOE 5-methyl cytidine 3'-phosphorothioate
  modified_base 19: mod_base = OTHER; note = 2'-MOE thymidine 3'-phosphorothioate
  modified_base 20: mod_base = OTHER; note = 2'-MOE 5-methyl cytidine
ttgggactgctctctttctc

SEQ ID NO: 3963 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE thymidine 3'-phosphorothioate
  modified_base 4: mod_base = OTHER; note = 2'-MOE guanosine 3'-phosphorothioate
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8..9: mod_base = OTHER; note = 2'-deoxyguanosine 3'-phosphorothioate
  modified_base 10: mod_base = OTHER; note = 5-methyl 2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14..15: mod_base = OTHER; note = 2'-deoxyadenosine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE thymidine
agtgcatggcatcaaaaatt

SEQ ID NO: 3964 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..4: mod_base = OTHER; note = 2'-MOE adenosine 3'-phosphorothioate
  modified_base 5: mod_base = OTHER; note = 2'-MOE 5-methyl cytidine 3'-phosphorothioate
  modified_base 6..7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE 5-methyl cytidine 3'-phosphorothioate
  modified_base 20: mod_base = OTHER; note = 2'-MOE thymidine
ttaacaatatcatataatct

SEQ ID NO: 3965 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphorothioate
  modified_base 4: mod_base = OTHER; note = 2'-MOE guanosine 3'-phosphorothioate
  modified_base 5: mod_base = OTHER; note = 2'-MOE 5-methyl cytidine 3'-phosphorothioate
  modified_base 6..7: mod_base = OTHER; note = 2'-deoxythymidine 3'-phosphorothioate
  modified_base 8..9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11..12: mod_base = OTHER; note = 5-methyl 2'-deoxycytidine 3'-phosphorothioate
  modified_base 13: mod_base = OTHER; note = 2'-deoxyadenosine 3'-phosphorothioate
  modified_base 14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphorothioate
  modified_base 17: mod_base = OTHER; note = 2'-MOE thymidine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE thymidine
atagcttccaccacaatatt

SEQ ID NO: 3966 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE thymidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 5-methyl 2'-deoxycytidine 3'-phosphorothioate
  modified_base 9..10: mod_base = OTHER; note = 2'-deoxythymidine 3'-phosphorothioate
  modified_base 11..12: mod_base = OTHER; note = 5-methyl 2'-deoxycytidine 3'-phosphorothioate
  modified_base 13: mod_base = OTHER; note = 2'-deoxyadenosine 3'-phosphorothioate
  modified_base 14..15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE 5-methyl cytidine 3'-phosphodiester
  modified_base 18..19: mod_base = OTHER; note = 2'-MOE adenosine 3'-phosphorothioate
  modified_base 20: mod_base = OTHER; note = 2'-MOE thymidine
ttcatagcttccaccacaat

SEQ ID NO: 3967 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE thymidine 3'-phosphodiester
  modified_base 3..4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 2'-deoxyguanosine 3'-phosphorothioate
  modified_base 10: mod_base = OTHER; note = 5-methyl 2'-deoxycytidine 3'-phosphorothioate
  modified_base 11..12: mod_base = OTHER; note = 2'-deoxythymidine 3'-phosphorothioate
  modified_base 13..14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
ctttcatagcttccaccaca

SEQ ID NO: 3968 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphorothioate
  modified_base 4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 5-methyl 2'-deoxycytidine 3'-phosphorothioate
  modified_base 7..9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18: mod_base = OTHER; note = 2'-MOE adenosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE thymidine
aagtccaaatgtgtcaaact

SEQ ID NO: 3969 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE adenosine 3'-phosphorothioate
  modified_base 4: mod_base = OTHER; note = 2'-MOE guanosine 3'-phosphorothioate
  modified_base 5: mod_base = OTHER; note = 2'-MOE thymidine 3'-phosphorothioate
  modified_base 6..7: mod_base = OTHER; note = 5-methyl 2'-deoxycytidine 3'-phosphorothioate
  modified_base 8..10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = 2'-deoxyguanosine 3'-phosphorothioate
  modified_base 15: mod_base = OTHER; note = 2'-deoxythymidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18..19: mod_base = OTHER; note = 2'-MOE adenosine 3'-phosphorothioate
  modified_base 20: mod_base = OTHER; note = 2'-MOE 5-methyl cytidine
caagtccaaatgtgtcaaac

SEQ ID NO: 3970 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE 5-methyl cytidine 3'-phosphodiester
  modified_base 3..4: mod_base = OTHER; note = 2'-MOE adenosine 3'-phosphorothioate
  modified_base 5: mod_base = OTHER; note = 2'-MOE guanosine 3'-phosphorothioate
  modified_base 6: mod_base = OTHER; note = 2'-deoxythymidine 3'-phosphorothioate
  modified_base 7..8: mod_base = OTHER; note = 5-methyl 2'-deoxycytidine 3'-phosphorothioate
  modified_base 9..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-deoxythymidine 3'-phosphorothioate
  modified_base 15: mod_base = OTHER; note = 2'-deoxyguanosine 3'-phosphorothioate
  modified_base 16: mod_base = OTHER; note = 2'-MOE thymidine 3'-phosphorothioate
  modified_base 17: mod_base = OTHER; note = 2'-MOE 5-methyl cytidine 3'-phosphodiester
  modified_base 18..19: mod_base = OTHER; note = 2'-MOE adenosine 3'-phosphorothioate
  modified_base 20: mod_base = OTHER; note = 2'-MOE adenosine
gcaagtccaaatgtgtcaaa

SEQ ID NO: 3971 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9..10: mod_base = OTHER; note = 5-methyl 2'-deoxycytidine 3'-phosphorothioate
  modified_base 11..13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 2'-deoxyguanosine 3'-phosphorothioate
  modified_base 16: mod_base = OTHER; note = 2'-MOE thymidine 3'-phosphorothioate
  modified_base 17: mod_base = OTHER; note = 2'-MOE guanosine 3'-phosphodiester
  modified_base 18: mod_base = OTHER; note = 2'-MOE thymidine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
gtgcaagtccaaatgtgtca

SEQ ID NO: 3972 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE thymidine 3'-phosphodiester
  modified_base 3: mod_base = OTHER; note = 2'-MOE thymidine 3'-phosphorothioate
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7..8: mod_base = OTHER; note = 2'-deoxythymidine 3'-phosphorothioate
  modified_base 9..10: mod_base = OTHER; note = 5-methyl 2'-deoxycytidine 3'-phosphorothioate
  modified_base 11..12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxyadenosine 3'-phosphorothioate
  modified_base 15: mod_base = OTHER; note = 2'-deoxyguanosine 3'-phosphorothioate
  modified_base 16: mod_base = OTHER; note = 2'-MOE thymidine 3'-phosphorothioate
  modified_base 17: mod_base = OTHER; note = 2'-MOE 5-methyl cytidine 3'-phosphodiester
  modified_base 18: mod_base = OTHER; note = 2'-MOE thymidine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
cttcagttccttcagtctca

SEQ ID NO: 3973 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE 5-methyl cytidine 3'-phosphodiester
  modified_base 3..4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8..9: mod_base = OTHER; note = 2'-deoxythymidine 3'-phosphorothioate
  modified_base 10..11: mod_base = OTHER; note = 5-methyl 2'-deoxycytidine 3'-phosphorothioate
  modified_base 12..13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE guanosine 3'-phosphorothioate
  modified_base 17: mod_base = OTHER; note = 2'-MOE thymidine 3'-phosphodiester
  modified_base 18: mod_base = OTHER; note = 2'-MOE 5-methyl cytidine 3'-phosphorothioate
  modified_base 19: mod_base = OTHER; note = 2'-MOE thymidine 3'-phosphorothioate
  modified_base 20: mod_base = OTHER; note = 2'-MOE 5-methyl cytidine
tcttcagttccttcagtctc

SEQ ID NO: 3974 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..5: mod_base = OTHER; note = 2'-MOE adenosine 3'-phosphorothioate
  modified_base 6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9..10: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxyguanosine 3'-phosphorothioate
  modified_base 14..15: mod_base = OTHER; note = 2'-deoxythymidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE 5-methyl cytidine 3'-phosphodiester
  modified_base 18..19: mod_base = OTHER; note = 2'-MOE thymidine 3'-phosphorothioate
  modified_base 20: mod_base = OTHER; note = 2'-MOE 5-methyl cytidine
ttaaaatcttcagttccttc

SEQ ID NO: 3975 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE 5-methyl cytidine 3'-phosphorothioate
  modified_base 4: mod_base = OTHER; note = 2'-MOE thymidine 3'-phosphorothioate
  modified_base 5: mod_base = OTHER; note = 2'-MOE guanosine 3'-phosphorothioate
  modified_base 6: mod_base = OTHER; note = 5-methyl 2'-deoxycytidine 3'-phosphorothioate
  modified_base 7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxythymidine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18: mod_base = OTHER; note = 2'-MOE guanosine 3'-phosphorothioate
  modified_base 19: mod_base = OTHER; note = 2'-MOE adenosine 3'-phosphorothioate
  modified_base 20: mod_base = OTHER; note = 2'-MOE 5-methyl cytidine
tgctgctcatatctaaagac

SEQ ID NO: 3976 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4: mod_base = OTHER; note = 2'-MOE 5-methyl cytidine 3'-phosphorothioate
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7: mod_base = OTHER; note = 5-methyl 2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxythymidine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18: mod_base = OTHER; note = 2'-MOE adenosine 3'-phosphorothioate
  modified_base 19: mod_base = OTHER; note = 2'-MOE guanosine 3'-phosphorothioate
  modified_base 20: mod_base = OTHER; note = 2'-MOE adenosine
ttgctgctcatatctaaaga

SEQ ID NO: 3977 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 5-methyl 2'-deoxycytidine 3'-phosphorothioate
  modified_base 9: mod_base = OTHER; note = 2'-deoxythymidine 3'-phosphorothioate
  modified_base 10: mod_base = OTHER; note = 2'-deoxyguanosine 3'-phosphorothioate
  modified_base 11: mod_base = OTHER; note = 5-methyl 2'-deoxycytidine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE adenosine 3'-phosphorothioate
  modified_base 17: mod_base = OTHER; note = 2'-MOE thymidine 3'-phosphodiester
  modified_base 18: mod_base = OTHER; note = 2'-MOE 5-methyl cytidine 3'-phosphorothioate
  modified_base 19: mod_base = OTHER; note = 2'-MOE thymidine 3'-phosphorothioate
  modified_base 20: mod_base = OTHER; note = 2'-MOE adenosine
atcattgctgctcatatcta

SEQ ID NO: 3978 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE thymidine 3'-phosphorothioate
  modified_base 4: mod_base = OTHER; note = 2'-MOE 5-methyl cytidine 3'-phosphorothioate
  modified_base 5: mod_base = OTHER; note = 2'-MOE guanosine 3'-phosphorothioate
  modified_base 6: mod_base = OTHER; note = 2'-deoxyguanosine 3'-phosphorothioate
  modified_base 7..8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11..12: mod_base = OTHER; note = 2'-deoxyadenosine 3'-phosphorothioate
  modified_base 13..14: mod_base = OTHER; note = 2'-deoxyguanosine 3'-phosphorothioate
  modified_base 15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE guanosine 3'-phosphorothioate
  modified_base 20: mod_base = OTHER; note = 2'-MOE 5-methyl cytidine
attcggttataaggcacagc

SEQ ID NO: 3979 - DNA, 20 bp, synthetic construct
  source 1..20: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3..4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6..7: mod_base = OTHER; note = 2'-deoxyguanosine 3'-phosphorothioate
  modified_base 8..9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14..15: mod_base = OTHER; note = 2'-deoxyguanosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE guanosine
cattcggttataaggcacag

SEQ ID NO: 3980 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphorothioate
  modified_base 4..5: mod_base = OTHER; note = 2'-MOE thymidine 3'-phosphorothioate
  modified_base 6: mod_base = OTHER; note = 5-methyl 2'-deoxycytidine 3'-phosphorothioate
  modified_base 7..8: mod_base = OTHER; note = 2'-deoxyguanosine 3'-phosphorothioate
  modified_base 9..10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13..14: mod_base = OTHER; note = 2'-deoxyadenosine 3'-phosphorothioate
  modified_base 15: mod_base = OTHER; note = 2'-deoxyguanosine 3'-phosphorothioate
  modified_base 16: mod_base = OTHER; note = 2'-MOE guanosine 3'-phosphorothioate
  modified_base 17: mod_base = OTHER; note = 2'-MOE 5-methyl cytidine 3'-phosphodiester
  modified_base 18: mod_base = OTHER; note = 2'-MOE adenosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
tcattcggttataaggcaca

SEQ ID NO: 3981 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE 5-methyl cytidine 3'-phosphorothioate
  modified_base 4: mod_base = OTHER; note = 2'-MOE adenosine 3'-phosphorothioate
  modified_base 5: mod_base = OTHER; note = 2'-MOE thymidine 3'-phosphorothioate
  modified_base 6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8..9: mod_base = OTHER; note = 2'-deoxyguanosine 3'-phosphorothioate
  modified_base 10..11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14..15: mod_base = OTHER; note = 2'-deoxyadenosine 3'-phosphorothioate
  modified_base 16: mod_base = OTHER; note = 2'-MOE guanosine 3'-phosphorothioate
  modified_base 17: mod_base = OTHER; note = 2'-MOE guanosine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE 5-methyl cytidine
ttcattcggttataaggcac

SEQ ID NO: 3982 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE thymidine 3'-phosphorothioate
  modified_base 4: mod_base = OTHER; note = 2'-MOE 5-methyl cytidine 3'-phosphorothioate
  modified_base 5: mod_base = OTHER; note = 2'-MOE adenosine 3'-phosphorothioate
  modified_base 6..7: mod_base = OTHER; note = 2'-deoxythymidine 3'-phosphorothioate
  modified_base 8: mod_base = OTHER; note = 5-methyl 2'-deoxycytidine 3'-phosphorothioate
  modified_base 9..10: mod_base = OTHER; note = 2'-deoxyguanosine 3'-phosphorothioate
  modified_base 11..12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphorothioate
  modified_base 17: mod_base = OTHER; note = 2'-MOE guanosine 3'-phosphodiester
  modified_base 18: mod_base = OTHER; note = 2'-MOE guanosine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
tttcattcggttataaggca

SEQ ID NO: 3983 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE thymidine 3'-phosphodiester
  modified_base 3..4: mod_base = OTHER; note = 2'-MOE thymidine 3'-phosphorothioate
  modified_base 5: mod_base = OTHER; note = 2'-MOE 5-methyl cytidine 3'-phosphorothioate
  modified_base 6: mod_base = OTHER; note = 2'-deoxyadenosine 3'-phosphorothioate
  modified_base 7..8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10..11: mod_base = OTHER; note = 2'-deoxyguanosine 3'-phosphorothioate
  modified_base 12..13: mod_base = OTHER; note = 2'-deoxythymidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18..19: mod_base = OTHER; note = 2'-MOE guanosine 3'-phosphorothioate
  modified_base 20: mod_base = OTHER; note = 2'-MOE 5-methyl cytidine
gtttcattcggttataaggc

SEQ ID NO: 3984 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3..4: mod_base = OTHER; note = 2'-MOE adenosine 3'-phosphorothioate
  modified_base 5: mod_base = OTHER; note = 2'-MOE guanosine 3'-phosphorothioate
  modified_base 6..8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11..12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14..15: mod_base = OTHER; note = 2'-deoxyguanosine 3'-phosphorothioate
  modified_base 16: mod_base = OTHER; note = 2'-MOE thymidine 3'-phosphorothioate
  modified_base 17: mod_base = OTHER; note = 2'-MOE thymidine 3'-phosphodiester
  modified_base 18: mod_base = OTHER; note = 2'-MOE adenosine 3'-phosphorothioate
  modified_base 19: mod_base = OTHER; note = 2'-MOE thymidine 3'-phosphorothioate
  modified_base 20: mod_base = OTHER; note = 2'-MOE adenosine
ataagtttcattcggttata

SEQ ID NO: 3985 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3: mod_base = OTHER; note = 2'-MOE guanosine 3'-phosphorothioate
  modified_base 4: mod_base = OTHER; note = 2'-MOE thymidine 3'-phosphorothioate
  modified_base 5: mod_base = OTHER; note = 2'-MOE guanosine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9..10: mod_base = OTHER; note = 2'-deoxyguanosine 3'-phosphorothioate
  modified_base 11: mod_base = OTHER; note = 5-methyl 2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18..19: mod_base = OTHER; note = 2'-MOE adenosine 3'-phosphorothioate
  modified_base 20: mod_base = OTHER; note = 2'-MOE thymidine
gagtgcatggcatcaaaaat

SEQ ID NO: 3986 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE guanosine 3'-phosphodiester
  modified_base 3: mod_base = OTHER; note = 2'-MOE adenosine 3'-phosphorothioate
  modified_base 4: mod_base = OTHER; note = 2'-MOE guanosine 3'-phosphorothioate
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7: mod_base = OTHER; note = 5-methyl 2'-deoxycytidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10..11: mod_base = OTHER; note = 2'-deoxyguanosine 3'-phosphorothioate
  modified_base 12: mod_base = OTHER; note = 5-methyl 2'-deoxycytidine 3'-phosphorothioate
  modified_base 13: mod_base = OTHER; note = 2'-deoxyadenosine 3'-phosphorothioate
  modified_base 14: mod_base = OTHER; note = 2'-deoxythymidine 3'-phosphorothioate
  modified_base 15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE adenosine 3'-phosphodiester
  modified_base 18..19: mod_base = OTHER; note = 2'-MOE adenosine 3'-phosphorothioate
  modified_base 20: mod_base = OTHER; note = 2'-MOE adenosine
tgagtgcatggcatcaaaaa

SEQ ID NO: 3987 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE guanosine 3'-phosphorothioate
  modified_base 4: mod_base = OTHER; note = 2'-MOE adenosine 3'-phosphorothioate
  modified_base 5: mod_base = OTHER; note = 2'-MOE guanosine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8: mod_base = OTHER; note = 5-methyl 2'-deoxycytidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11..12: mod_base = OTHER; note = 2'-deoxyguanosine 3'-phosphorothioate
  modified_base 13: mod_base = OTHER; note = 5-methyl 2'-deoxycytidine 3'-phosphorothioate
  modified_base 14: mod_base = OTHER; note = 2'-deoxyadenosine 3'-phosphorothioate
  modified_base 15: mod_base = OTHER; note = 2'-deoxythymidine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18..19: mod_base = OTHER; note = 2'-MOE adenosine 3'-phosphorothioate
  modified_base 20: mod_base = OTHER; note = 2'-MOE adenosine
atgagtgcatggcatcaaaa

SEQ ID NO: 3988 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphorothioate
  modified_base 4: mod_base = OTHER; note = 2'-MOE guanosine 3'-phosphorothioate
  modified_base 5: mod_base = OTHER; note = 2'-MOE adenosine 3'-phosphorothioate
  modified_base 6: mod_base = OTHER; note = 2'-deoxyguanosine 3'-phosphorothioate
  modified_base 7: mod_base = OTHER; note = 2'-deoxythymidine 3'-phosphorothioate
  modified_base 8: mod_base = OTHER; note = 2'-deoxyguanosine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12..13: mod_base = OTHER; note = 2'-deoxyguanosine 3'-phosphorothioate
  modified_base 14: mod_base = OTHER; note = 5-methyl 2'-deoxycytidine 3'-phosphorothioate
  modified_base 15: mod_base = OTHER; note = 2'-deoxyadenosine 3'-phosphorothioate
  modified_base 16: mod_base = OTHER; note = 2'-MOE thymidine 3'-phosphorothioate
  modified_base 17: mod_base = OTHER; note = 2'-MOE 5-methyl cytidine 3'-phosphodiester
  modified_base 18..19: mod_base = OTHER; note = 2'-MOE adenosine 3'-phosphorothioate
  modified_base 20: mod_base = OTHER; note = 2'-MOE adenosine
aatgagtgcatggcatcaaa

SEQ ID NO: 3989 - DNA, 20 bp, synthetic construct
  source 1..20: mol_type = other DNA
  modified_base 1: mod_base = OTHER; note = 2'-MOE adenosine 3'-phosphorothioate
  modified_base 2: mod_base = OTHER; note = 2'-MOE adenosine 3'-phosphodiester
  modified_base 3: mod_base = OTHER; note = 2'-MOE adenosine 3'-phosphorothioate
  modified_base 4: mod_base = OTHER; note = 2'-MOE thymidine 3'-phosphorothioate
  modified_base 5: mod_base = OTHER; note = 2'-MOE guanosine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10: mod_base = OTHER; note = 5-methyl 2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13..14: mod_base = OTHER; note = 2'-deoxyguanosine 3'-phosphorothioate
  modified_base 15: mod_base = OTHER; note = 5-methyl 2'-deoxycytidine 3'-phosphorothioate
  modified_base 16: mod_base = OTHER; note = 2'-MOE adenosine 3'-phosphorothioate
  modified_base 17: mod_base = OTHER; note = 2'-MOE thymidine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE adenosine
aaatgagtgcatggcatcaa

SEQ ID NO: 3990 - DNA, 20 bp, synthetic construct
  source 1..20: mol_type = other DNA
  modified_base 1: mod_base = OTHER; note = 2'-MOE guanosine 3'-phosphorothioate
  modified_base 2: mod_base = OTHER; note = 2'-MOE adenosine 3'-phosphodiester
  modified_base 3..4: mod_base = OTHER; note = 2'-MOE adenosine 3'-phosphorothioate
  modified_base 5: mod_base = OTHER; note = 2'-MOE thymidine 3'-phosphorothioate
  modified_base 6: mod_base = OTHER; note = 2'-deoxyguanosine 3'-phosphorothioate
  modified_base 7: mod_base = OTHER; note = 2'-deoxyadenosine 3'-phosphorothioate
  modified_base 8: mod_base = OTHER; note = 2'-deoxyguanosine 3'-phosphorothioate
  modified_base 10: mod_base = OTHER; note = 2'-deoxyguanosine 3'-phosphorothioate
  modified_base 9: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14..15: mod_base = OTHER; note = 2'-deoxyguanosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine 3'-phosphodiester
  modified_base 18: mod_base = OTHER; note = 2'-MOE thymidine 3'-phosphorothioate
  modified_base 19: mod_base = OTHER; note = 2'-MOE 5-methyl cytidine 3'-phosphorothioate
  modified_base 20: mod_base = OTHER; note = 2'-MOE adenosine
gaaatgagtgcatggcatca

SEQ ID NO: 3991 - DNA, 20 bp, synthetic construct
  source 1..20: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3..4: mod_base = OTHER; note = 2'-MOE guanosine 3'-phosphorothioate
  modified_base 5: mod_base = OTHER; note = 2'-MOE 5-methyl cytidine 3'-phosphorothioate
  modified_base 6: mod_base = OTHER; note = 2'-deoxythymidine 3'-phosphorothioate
  modified_base 7..8: mod_base = OTHER; note = 2'-deoxyguanosine 3'-phosphorothioate
  modified_base 9..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyguanosine 3'-phosphorothioate
  modified_base 14: mod_base = OTHER; note = 2'-deoxyadenosine 3'-phosphorothioate
  modified_base 15: mod_base = OTHER; note = 2'-deoxyguanosine 3'-phosphorothioate
  modified_base 16: mod_base = OTHER; note = 2'-MOE thymidine 3'-phosphorothioate
  modified_base 17: mod_base = OTHER; note = 2'-MOE guanosine 3'-phosphodiester
  modified_base 18: mod_base = OTHER; note = 2'-MOE 5-methyl cytidine 3'-phosphorothioate
  modified_base 19: mod_base = OTHER; note = 2'-MOE adenosine 3'-phosphorothioate
  modified_base 20: mod_base = OTHER; note = 2'-MOE thymidine
ttggctggaaatgagtgcat

SEQ ID NO: 3992 - DNA, 17 bp, synthetic construct
  source 1..17: mol_type = other DNA
  modified_base 1: mod_base = OTHER; note = 2'-MOE thymidine 3'-phosphorothioate
  modified_base 2..3: mod_base = OTHER; note = 2'-MOE adenosine 3'-phosphodiester
  modified_base 4: mod_base = OTHER; note = 2'-MOE 5-methyl cytidine 3'-phosphorothioate
  modified_base 5..6: mod_base = OTHER; note = 2'-deoxyadenosine 3'-phosphorothioate
  modified_base 7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 5-methyl 2'-deoxycytidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 2'-deoxyadenosine 3'-phosphorothioate
  modified_base 14: mod_base = OTHER; note = cEt thymidine 3'-phosphodiester
  modified_base 15..16: mod_base = OTHER; note = 2'-MOE adenosine 3'-phosphorothioate
  modified_base 17: mod_base = OTHER; note = 2'-MOE thymidine
taacaatatcatataat

SEQ ID NO: 3993 - DNA, 17 bp, synthetic construct
  source 1..17: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE adenosine 3'-phosphorothioate
  modified_base 5: mod_base = OTHER; note = 5-methyl 2'-deoxycytidine 3'-phosphorothioate
  modified_base 6..7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = cEt adenosine 3'-phosphodiester
  modified_base 15: mod_base = OTHER; note = 2'-MOE thymidine 3'-phosphorothioate
  modified_base 16: mod_base = OTHER; note = 2'-MOE adenosine 3'-phosphorothioate
  modified_base 17: mod_base = OTHER; note = 2'-MOE adenosine
ttaacaatatcatataa

SEQ ID NO: 3994 - DNA, 17 bp, synthetic construct
  source 1..17: mol_type = other DNA
  modified_base 1: mod_base = OTHER; note = 2'-MOE 5-methyl cytidine 3'-phosphorothioate
  modified_base 2..3: mod_base = OTHER; note = 2'-MOE thymidine 3'-phosphodiester
  modified_base 4: mod_base = OTHER; note = 2'-MOE adenosine 3'-phosphorothioate
  modified_base 5: mod_base = OTHER; note = 2'-deoxyadenosine 3'-phosphorothioate
  modified_base 6: mod_base = OTHER; note = 5-methyl 2'-deoxycytidine 3'-phosphorothioate
  modified_base 7..8: mod_base = OTHER; note = 2'-deoxyadenosine 3'-phosphorothioate
  modified_base 9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 5-methyl 2'-deoxycytidine 3'-phosphorothioate
  modified_base 13: mod_base = OTHER; note = 2'-deoxyadenosine 3'-phosphorothioate
  modified_base 14: mod_base = OTHER; note = cEt thymidine 3'-phosphodiester
  modified_base 15: mod_base = OTHER; note = 2'-MOE adenosine 3'-phosphorothioate
  modified_base 16: mod_base = OTHER; note = 2'-MOE thymidine 3'-phosphorothioate
  modified_base 17: mod_base = OTHER; note = 2'-MOE adenosine
cttaacaatatcatata

SEQ ID NO: 3995 - DNA, 17 bp, synthetic construct
  source 1..17: mol_type = other DNA
  modified_base 1: mod_base = OTHER; note = 2'-MOE adenosine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphodiester
  modified_base 4: mod_base = OTHER; note = 2'-MOE thymidine 3'-phosphorothioate
  modified_base 5..6: mod_base = OTHER; note = 2'-deoxyadenosine 3'-phosphorothioate
  modified_base 7: mod_base = OTHER; note = 5-methyl 2'-deoxycytidine 3'-phosphorothioate
  modified_base 8..9: mod_base = OTHER; note = 2'-deoxyadenosine 3'-phosphorothioate
  modified_base 10: mod_base = OTHER; note = 2'-deoxythymidine 3'-phosphorothioate
  modified_base 11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = cEt adenosine 3'-phosphodiester
  modified_base 15: mod_base = OTHER; note = 2'-MOE thymidine 3'-phosphorothioate
  modified_base 16: mod_base = OTHER; note = 2'-MOE adenosine 3'-phosphorothioate
  modified_base 17: mod_base = OTHER; note = 2'-MOE thymidine
acttaacaatatcatat

SEQ ID NO: 3996 - DNA, 17 bp, synthetic construct
  source 1..17: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE 5-methyl cytidine 3'-phosphodiester
  modified_base 4: mod_base = OTHER; note = 2'-MOE thymidine 3'-phosphorothioate
  modified_base 5: mod_base = OTHER; note = 2'-deoxythymidine 3'-phosphorothioate
  modified_base 6..7: mod_base = OTHER; note = 2'-deoxyadenosine 3'-phosphorothioate
  modified_base 8: mod_base = OTHER; note = 5-methyl 2'-deoxycytidine 3'-phosphorothioate
  modified_base 9..10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyadenosine 3'-phosphorothioate
  modified_base 13: mod_base = OTHER; note = 2'-deoxythymidine 3'-phosphorothioate
  modified_base 14: mod_base = OTHER; note = cEt 5-methyl cytidine 3'-phosphodiester
  modified_base 15: mod_base = OTHER; note = 2'-MOE adenosine 3'-phosphorothioate
  modified_base 16: mod_base = OTHER; note = 2'-MOE thymidine 3'-phosphorothioate
  modified_base 17: mod_base = OTHER; note = 2'-MOE adenosine
cacttaacaatatcata

SEQ ID NO: 3997 - DNA, 17 bp, synthetic construct
  source 1..17: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE 5-methyl cytidine 3'-phosphodiester
  modified_base 4: mod_base = OTHER; note = 2'-MOE adenosine 3'-phosphorothioate
  modified_base 5: mod_base = OTHER; note = 5-methyl 2'-deoxycytidine 3'-phosphorothioate
  modified_base 6: mod_base = OTHER; note = 2'-deoxythymidine 3'-phosphorothioate
  modified_base 7: mod_base = OTHER; note = 2'-deoxyguanosine 3'-phosphorothioate
  modified_base 8..9: mod_base = OTHER; note = 2'-deoxyadenosine 3'-phosphorothioate
  modified_base 10: mod_base = OTHER; note = 2'-deoxythymidine 3'-phosphorothioate
  modified_base 11..12: mod_base = OTHER; note = 5-methyl 2'-deoxycytidine 3'-phosphorothioate
  modified_base 13: mod_base = OTHER; note = 2'-deoxyadenosine 3'-phosphorothioate
  modified_base 14: mod_base = OTHER; note = cEt thymidine 3'-phosphodiester
  modified_base 15: mod_base = OTHER; note = 2'-MOE adenosine 3'-phosphorothioate
  modified_base 16: mod_base = OTHER; note = 2'-MOE guanosine 3'-phosphorothioate
  modified_base 17: mod_base = OTHER; note = 2'-MOE 5-methyl cytidine
agcactgaatccatagc

SEQ ID NO: 3998 - DNA, 17 bp, synthetic construct
  source 1..17: mol_type = other DNA
  modified_base 1: mod_base = OTHER; note = 2'-MOE adenosine 3'-phosphorothioate
  modified_base 2: mod_base = OTHER; note = 2'-MOE 5-methyl cytidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphorothioate
  modified_base 5..6: mod_base = OTHER; note = 2'-deoxythymidine 3'-phosphorothioate
  modified_base 7: mod_base = OTHER; note = 5-methyl 2'-deoxycytidine 3'-phosphorothioate
  modified_base 8: mod_base = OTHER; note = 2'-deoxythymidine 3'-phosphorothioate
  modified_base 9: mod_base = OTHER; note = 2'-deoxyguanosine 3'-phosphorothioate
  modified_base 10..11: mod_base = OTHER; note = 2'-deoxyadenosine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = cEt 5-methyl cytidine 3'-phosphodiester
  modified_base 15: mod_base = OTHER; note = 2'-MOE 5-methyl cytidine 3'-phosphorothioate
  modified_base 16: mod_base = OTHER; note = 2'-MOE adenosine 3'-phosphorothioate
  modified_base 17: mod_base = OTHER; note = 2'-MOE guanosine
acatttctgaatcccag

SEQ ID NO: 3999 - DNA, 17 bp, synthetic construct
  source 1..17: mol_type = other DNA
  modified_base 1: mod_base = OTHER; note = 2'-MOE 5-methyl cytidine 3'-phosphorothioate
  modified_base 2: mod_base = OTHER; note = 2'-MOE 5-methyl cytidine 3'-phosphodiester
  modified_base 3: mod_base = OTHER; note = 2'-MOE thymidine 3'-phosphodiester
  modified_base 4: mod_base = OTHER; note = 2'-MOE thymidine 3'-phosphorothioate
  modified_base 5: mod_base = OTHER; note = 5-methyl 2'-deoxycytidine 3'-phosphorothioate
  modified_base 6: mod_base = OTHER; note = 2'-deoxyadenosine 3'-phosphorothioate
  modified_base 7: mod_base = OTHER; note = 2'-deoxyguanosine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxythymidine 3'-phosphorothioate
  modified_base 11: mod_base = OTHER; note = 5-methyl 2'-deoxycytidine 3'-phosphorothioate
  modified_base 12..13: mod_base = OTHER; note = 2'-deoxyadenosine 3'-phosphorothioate
  modified_base 14: mod_base = OTHER; note = cEt guanosine 3'-phosphodiester
  modified_base 15..16: mod_base = OTHER; note = 2'-MOE guanosine 3'-phosphorothioate
  modified_base 17: mod_base = OTHER; note = 2'-MOE guanosine
ccttcagtctcaagggg

SEQ ID NO: 4000 - DNA, 17 bp, synthetic construct
  source 1..17: mol_type = other DNA
  modified_base 1: mod_base = OTHER; note = 2'-MOE adenosine 3'-phosphorothioate
  modified_base 2: mod_base = OTHER; note = 2'-MOE thymidine 3'-phosphodiester
  modified_base 3: mod_base = OTHER; note = 2'-MOE adenosine 3'-phosphodiester
  modified_base 4: mod_base = OTHER; note = 2'-MOE thymidine 3'-phosphorothioate
  modified_base 5: mod_base = OTHER; note = 5-methyl 2'-deoxycytidine 3'-phosphorothioate
  modified_base 6: mod_base = OTHER; note = 2'-deoxythymidine 3'-phosphorothioate
  modified_base 7..9: mod_base = OTHER; note = 2'-deoxyadenosine 3'-phosphorothioate
  modified_base 10: mod_base = OTHER; note = 2'-deoxyguanosine 3'-phosphorothioate
  modified_base 11: mod_base = OTHER; note = 2'-deoxyadenosine 3'-phosphorothioate
  modified_base 12..13: mod_base = OTHER; note = 5-methyl 2'-deoxycytidine 3'-phosphorothioate
  modified_base 14: mod_base = OTHER; note = cEt guanosine 3'-phosphodiester
  modified_base 15: mod_base = OTHER; note = 2'-MOE 5-methyl cytidine 3'-phosphorothioate
  modified_base 16: mod_base = OTHER; note = 2'-MOE adenosine 3'-phosphorothioate
  modified_base 17: mod_base = OTHER; note = 2'-MOE adenosine
atatctaaagaccgcaa

SEQ ID NO: 4001 - DNA, 17 bp, synthetic construct
  source 1..17: mol_type = other DNA
  modified_base 1: mod_base = OTHER; note = 2'-MOE adenosine 3'-phosphorothioate
  modified_base 2..3: mod_base = OTHER; note = 2'-MOE adenosine 3'-phosphodiester
  modified_base 4: mod_base = OTHER; note = 2'-MOE 5-methyl cytidine 3'-phosphorothioate
  modified_base 5: mod_base = OTHER; note = 2'-deoxythymidine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9..10: mod_base = OTHER; note = 2'-deoxyguanosine 3'-phosphorothioate
  modified_base 11: mod_base = OTHER; note = 2'-deoxyadenosine 3'-phosphorothioate
  modified_base 12: mod_base = OTHER; note = 5-methyl 2'-deoxycytidine 3'-phosphorothioate
  modified_base 13: mod_base = OTHER; note = 2'-deoxythymidine 3'-phosphorothioate
  modified_base 14: mod_base = OTHER; note = cEt thymidine 3'-phosphodiester
  modified_base 15: mod_base = OTHER; note = 2'-MOE 5-methyl cytidine 3'-phosphorothioate
  modified_base 16: mod_base = OTHER; note = 2'-MOE guanosine 3'-phosphorothioate
  modified_base 17: mod_base = OTHER; note = 2'-MOE thymidine
aaactcatggacttcgt

SEQ ID NO: 4002 - DNA, 17 bp, synthetic construct
  source 1..17: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE thymidine 3'-phosphorothioate
  modified_base 5: mod_base = OTHER; note = 5-methyl 2'-deoxycytidine 3'-phosphorothioate
  modified_base 6..7: mod_base = OTHER; note = 2'-deoxyguanosine 3'-phosphorothioate
  modified_base 8..9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12..13: mod_base = OTHER; note = 2'-deoxyadenosine 3'-phosphorothioate
  modified_base 14: mod_base = OTHER; note = cEt guanosine 3'-phosphodiester
  modified_base 15: mod_base = OTHER; note = 2'-MOE guanosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine
cattcggttataaggca

SEQ ID NO: 4003 - DNA, 17 bp, synthetic construct
  source 1..17: mol_type = other DNA
  modified_base 1: mod_base = OTHER; note = 2'-MOE adenosine 3'-phosphorothioate
  modified_base 2..3: mod_base = OTHER; note = 2'-MOE 5-methyl cytidine 3'-phosphodiester
  modified_base 4: mod_base = OTHER; note = 2'-MOE 5-methyl cytidine 3'-phosphorothioate
  modified_base 5..7: mod_base = OTHER; note = 2'-deoxythymidine 3'-phosphorothioate
  modified_base 8..9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxythymidine 3'-phosphorothioate
  modified_base 14: mod_base = OTHER; note = cEt guanosine 3'-phosphodiester
  modified_base 15..16: mod_base = OTHER; note = 2'-MOE adenosine 3'-phosphorothioate
  modified_base 17: mod_base = OTHER; note = 2'-MOE 5-methyl cytidine
accctttccatgtgaac

SEQ ID NO: 4004 - DNA, 17 bp, synthetic construct
  source 1..17: mol_type = other DNA
  modified_base 1: mod_base = OTHER; note = 2'-MOE thymidine 3'-phosphorothioate
  modified_base 2..3: mod_base = OTHER; note = 2'-MOE thymidine 3'-phosphodiester
  modified_base 4: mod_base = OTHER; note = 2'-MOE 5-methyl cytidine 3'-phosphorothioate
  modified_base 5: mod_base = OTHER; note = 2'-deoxyadenosine 3'-phosphorothioate
  modified_base 7: mod_base = OTHER; note = 2'-deoxyadenosine 3'-phosphorothioate
  modified_base 6: mod_base = OTHER; note = 2'-deoxythymidine 3'-phosphorothioate
  modified_base 8: mod_base = OTHER; note = 2'-deoxyguanosine 3'-phosphorothioate
  modified_base 9: mod_base = OTHER; note = 5-methyl 2'-deoxycytidine 3'-phosphorothioate
  modified_base 10..11: mod_base = OTHER; note = 2'-deoxythymidine 3'-phosphorothioate
  modified_base 12..13: mod_base = OTHER; note = 5-methyl 2'-deoxycytidine 3'-phosphorothioate
  modified_base 14: mod_base = OTHER; note = cEt adenosine 3'-phosphodiester
  modified_base 15..16: mod_base = OTHER; note = 2'-MOE 5-methyl cytidine 3'-phosphorothioate
  modified_base 17: mod_base = OTHER; note = 2'-MOE adenosine
tttcatagcttccacca

SEQ ID NO: 4005 - DNA, 17 bp, synthetic construct
  source 1..17: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphorothioate
  modified_base 5: mod_base = OTHER; note = 2'-deoxyadenosine 3'-phosphorothioate
  modified_base 6..7: mod_base = OTHER; note = 2'-deoxyguanosine 3'-phosphorothioate
  modified_base 8: mod_base = OTHER; note = 2'-deoxyadenosine 3'-phosphorothioate
  modified_base 9: mod_base = OTHER; note = 5-methyl 2'-deoxycytidine 3'-phosphorothioate
  modified_base 10..11: mod_base = OTHER; note = 2'-deoxythymidine 3'-phosphorothioate
  modified_base 12..13: mod_base = OTHER; note = 5-methyl 2'-deoxycytidine 3'-phosphorothioate
  modified_base 14: mod_base = OTHER; note = cEt adenosine 3'-phosphodiester
  modified_base 15: mod_base = OTHER; note = 2'-MOE 5-methyl cytidine 3'-phosphorothioate
  modified_base 16: mod_base = OTHER; note = 2'-MOE adenosine 3'-phosphorothioate
  modified_base 17: mod_base = OTHER; note = 2'-MOE thymidine
catgaggacttccacat

SEQ ID NO: 4006 - DNA, 17 bp, synthetic construct
  source 1..17: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE thymidine 3'-phosphodiester
  modified_base 4: mod_base = OTHER; note = 2'-MOE guanosine 3'-phosphorothioate
  modified_base 5: mod_base = OTHER; note = 2'-deoxyguanosine 3'-phosphorothioate
  modified_base 6: mod_base = OTHER; note = 5-methyl 2'-deoxycytidine 3'-phosphorothioate
  modified_base 7: mod_base = OTHER; note = 2'-deoxyadenosine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10..13: mod_base = OTHER; note = 2'-deoxyadenosine 3'-phosphorothioate
  modified_base 14: mod_base = OTHER; note = cEt adenosine 3'-phosphodiester
  modified_base 15..16: mod_base = OTHER; note = 2'-MOE thymidine 3'-phosphorothioate
  modified_base 17: mod_base = OTHER; note = 2'-MOE adenosine
catggcatcaaaaatta

SEQ ID NO: 4007 - DNA, 17 bp, synthetic construct
  source 1..17: mol_type = other DNA
  modified_base 1: mod_base = OTHER; note = 2'-MOE 5-methyl cytidine 3'-phosphorothioate
  modified_base 2: mod_base = OTHER; note = 2'-MOE adenosine 3'-phosphodiester
  modified_base 3: mod_base = OTHER; note = 2'-MOE 5-methyl cytidine 3'-phosphodiester
  modified_base 4: mod_base = OTHER; note = 2'-MOE adenosine 3'-phosphorothioate
  modified_base 5..6: mod_base = OTHER; note = 2'-deoxyadenosine 3'-phosphorothioate
  modified_base 7: mod_base = OTHER; note = 5-methyl 2'-deoxycytidine 3'-phosphorothioate
  modified_base 8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12..13: mod_base = OTHER; note = 2'-deoxyguanosine 3'-phosphorothioate
  modified_base 14: mod_base = OTHER; note = cEt adenosine 3'-phosphodiester
  modified_base 15: mod_base = OTHER; note = 2'-MOE 5-methyl cytidine 3'-phosphorothioate
  modified_base 16: mod_base = OTHER; note = 2'-MOE thymidine 3'-phosphorothioate
  modified_base 17: mod_base = OTHER; note = 2'-MOE thymidine
cacaaactcatggactt

SEQ ID NO: 4008 - DNA, 17 bp, synthetic construct
  source 1..17: mol_type = other DNA
  modified_base 1: mod_base = OTHER; note = 2'-MOE adenosine 3'-phosphorothioate
  modified_base 2: mod_base = OTHER; note = 2'-MOE guanosine 3'-phosphodiester
  modified_base 3: mod_base = OTHER; note = 2'-MOE thymidine 3'-phosphodiester
  modified_base 4: mod_base = OTHER; note = 2'-MOE thymidine 3'-phosphorothioate
  modified_base 5..6: mod_base = OTHER; note = 5-methyl 2'-deoxycytidine 3'-phosphorothioate
  modified_base 7..8: mod_base = OTHER; note = 2'-deoxythymidine 3'-phosphorothioate
  modified_base 9: mod_base = OTHER; note = 5-methyl 2'-deoxycytidine 3'-phosphorothioate
  modified_base 10: mod_base = OTHER; note = 2'-deoxyadenosine 3'-phosphorothioate
  modified_base 11: mod_base = OTHER; note = 2'-deoxyguanosine 3'-phosphorothioate
  modified_base 12: mod_base = OTHER; note = 2'-deoxythymidine 3'-phosphorothioate
  modified_base 13: mod_base = OTHER; note = 5-methyl 2'-deoxycytidine 3'-phosphorothioate
  modified_base 14: mod_base = OTHER; note = cEt thymidine 3'-phosphodiester
  modified_base 15: mod_base = OTHER; note = 2'-MOE 5-methyl cytidine 3'-phosphorothioate
  modified_base 16: mod_base = OTHER; note = 2'-MOE adenosine 3'-phosphorothioate
  modified_base 17: mod_base = OTHER; note = 2'-MOE adenosine
agttccttcagtctcaa

SEQ ID NO: 4009 - DNA, 17 bp, synthetic construct
  source 1..17: mol_type = other DNA
  modified_base 1: mod_base = OTHER; note = 2'-MOE thymidine 3'-phosphorothioate
  modified_base 2: mod_base = OTHER; note = 2'-MOE thymidine 3'-phosphodiester
  modified_base 3: mod_base = OTHER; note = 2'-MOE 5-methyl cytidine 3'-phosphodiester
  modified_base 4: mod_base = OTHER; note = 2'-MOE guanosine 3'-phosphorothioate
  modified_base 5: mod_base = OTHER; note = 2'-deoxyguanosine 3'-phosphorothioate
  modified_base 6..7: mod_base = OTHER; note = 2'-deoxythymidine 3'-phosphorothioate
  modified_base 8: mod_base = OTHER; note = 2'-deoxyadenosine 3'-phosphorothioate
  modified_base 9: mod_base = OTHER; note = 2'-deoxythymidine 3'-phosphorothioate
  modified_base 10..11: mod_base = OTHER; note = 2'-deoxyadenosine 3'-phosphorothioate
  modified_base 12..13: mod_base = OTHER; note = 2'-deoxyguanosine 3'-phosphorothioate
  modified_base 14: mod_base = OTHER; note = cEt 5-methyl cytidine 3'-phosphodiester
  modified_base 15: mod_base = OTHER; note = 2'-MOE adenosine 3'-phosphorothioate
  modified_base 16: mod_base = OTHER; note = 2'-MOE 5-methyl cytidine 3'-phosphorothioate
  modified_base 17: mod_base = OTHER; note = 2'-MOE adenosine
ttcggttataaggcaca

SEQ ID NO: 4010 - DNA, 17 bp, synthetic construct
  source 1..17: mol_type = other DNA
  modified_base 1: mod_base = OTHER; note = 2'-MOE adenosine 3'-phosphorothioate
  modified_base 2..3: mod_base = OTHER; note = 2'-MOE thymidine 3'-phosphodiester
  modified_base 4: mod_base = OTHER; note = 2'-MOE thymidine 3'-phosphorothioate
  modified_base 5: mod_base = OTHER; note = 2'-deoxyadenosine 3'-phosphorothioate
  modified_base 6: mod_base = OTHER; note = 2'-deoxyguanosine 3'-phosphorothioate
  modified_base 7: mod_base = OTHER; note = 5-methyl 2'-deoxycytidine 3'-phosphorothioate
  modified_base 8..9: mod_base = OTHER; note = 2'-deoxythymidine 3'-phosphorothioate
  modified_base 10: mod_base = OTHER; note = 2'-deoxyadenosine 3'-phosphorothioate
  modified_base 11: mod_base = OTHER; note = 2'-deoxythymidine 3'-phosphorothioate
  modified_base 12: mod_base = OTHER; note = 2'-deoxyguanosine 3'-phosphorothioate
  modified_base 13: mod_base = OTHER; note = 2'-deoxyadenosine 3'-phosphorothioate
  modified_base 14: mod_base = OTHER; note = cEt thymidine 3'-phosphodiester
  modified_base 15: mod_base = OTHER; note = 2'-MOE guanosine 3'-phosphorothioate
  modified_base 16: mod_base = OTHER; note = 2'-MOE adenosine 3'-phosphorothioate
  modified_base 17: mod_base = OTHER; note = 2'-MOE adenosine
atttagcttatgatgaa

The invention claimed is:

1. A modified oligonucleotide according to the following formula:

(SEQ ID NO: 3855)

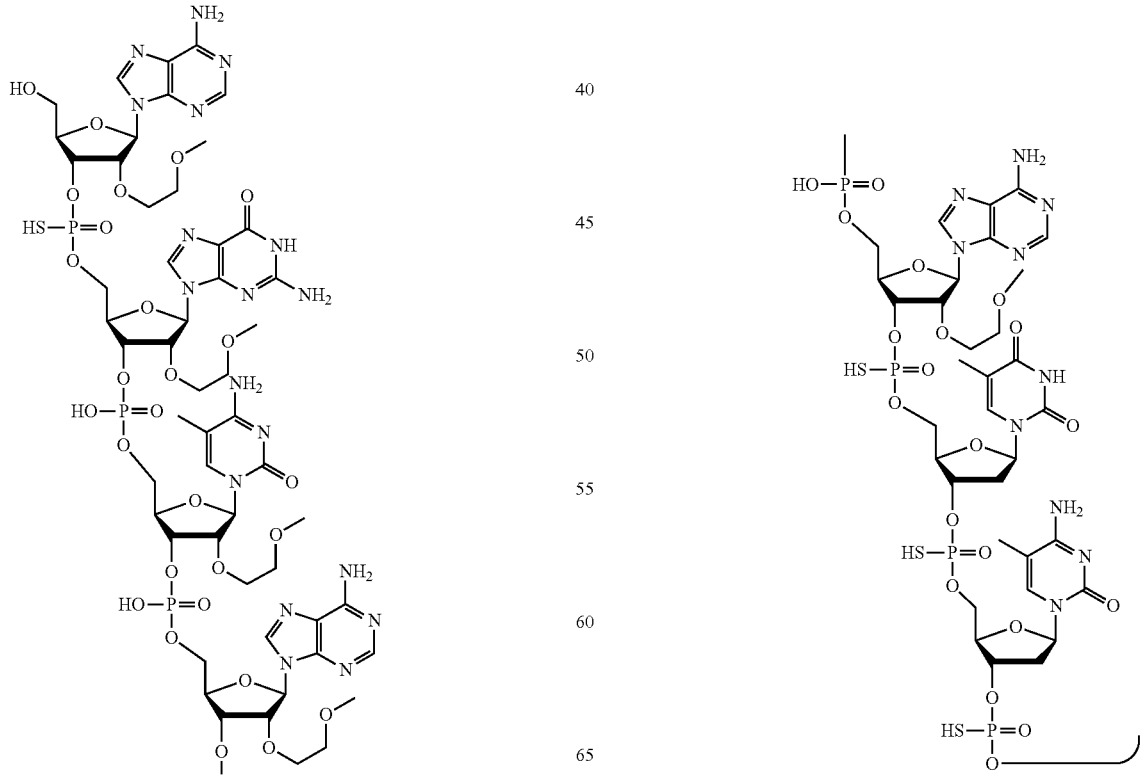

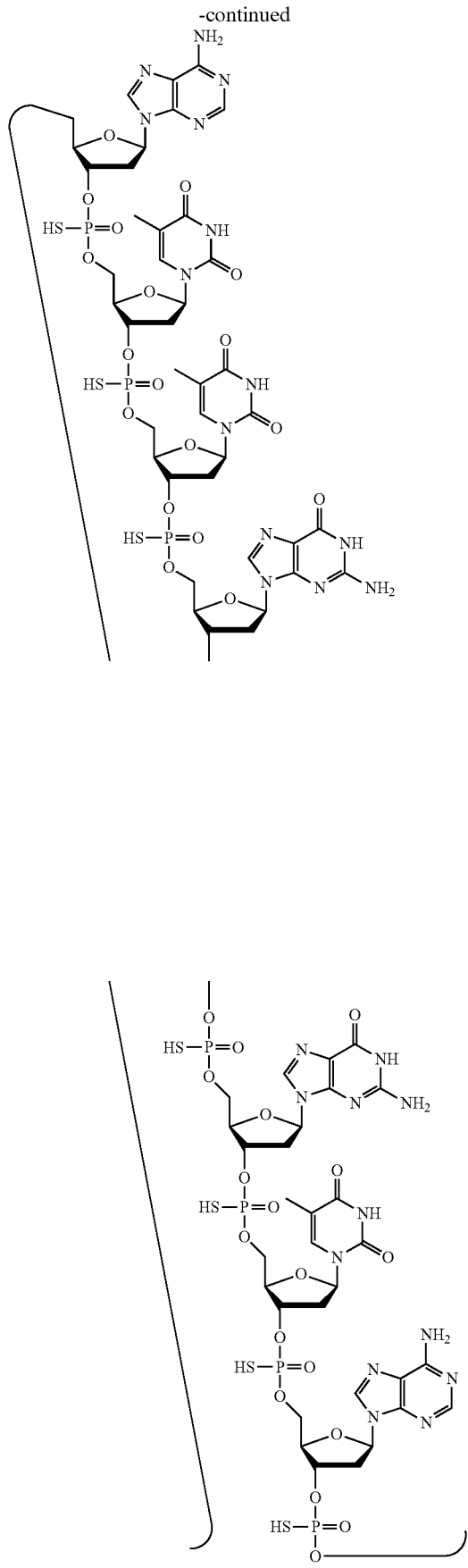
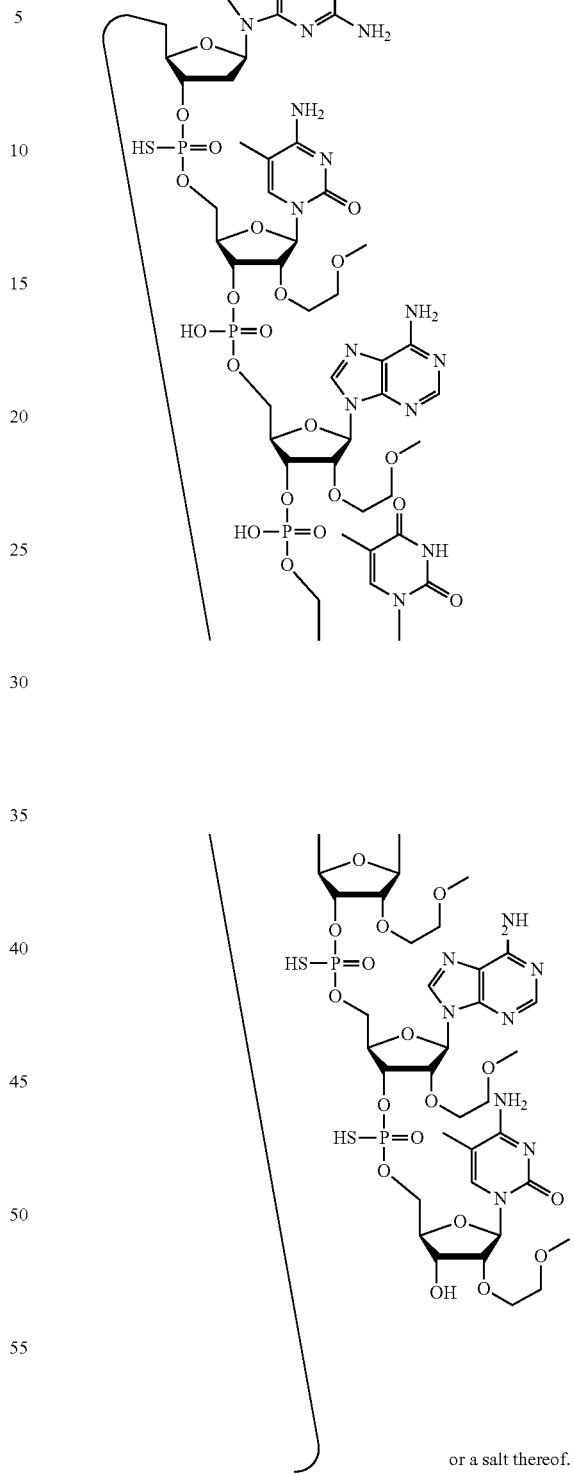
(SEQ ID NO: 3385) or a salt thereof.
2. The modified oligonucleotide of claim 1, which is a sodium salt or a potassium salt.
3. A modified oligonucleotide according to the following formula:

(SEQ ID NO: 3855)

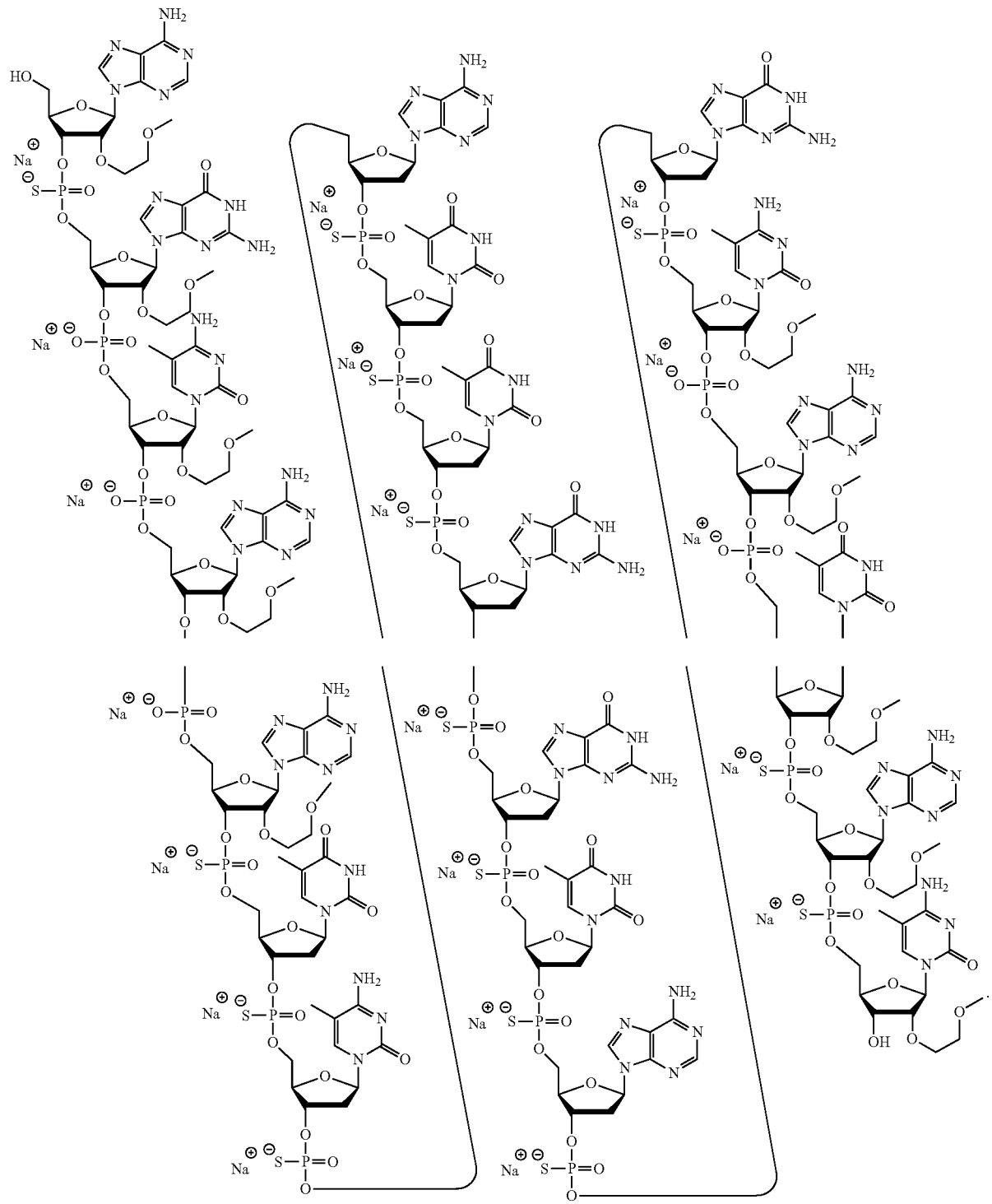

(SEQ ID NO: 3385).

4. An oligomeric compound comprising a modified oligonucleotide according to the following chemical notation (5' to 3'):

Aes Geo mCeo Aeo Aes Tds mCds Ads Tds Tds
Gds Gds Tds Ads Gds mCeo
Aeo Tes Aes mCe (SEQ TD NO: 3385);

wherein,
A=an adenine nucleobase,
mC=a 5-methyl cytosine nucleobase,
G=a guanine nucleobase,
T=a thymine nucleobase,
e=a 2'-MOE modified sugar,
d=a 2'-deoxyribose sugar, s=a phosphorothioate internucleoside linkage, and
o=a phosphodiester internucleoside linkage.

5. A population of modified oligonucleotides of claim 1, wherein all of the phosphorothioate internucleoside linkages of the modified oligonucleotides are stereorandom.

6. A pharmaceutical composition comprising the modified oligonucleotide of claim 1 and a pharmaceutically acceptable diluent or carrier.

7. The pharmaceutical composition of claim 6, wherein the pharmaceutically acceptable diluent is phosphate-buffered saline or artificial cerebrospinal fluid.

8. The pharmaceutical composition of claim 6, wherein the pharmaceutical composition consists essentially of the modified oligonucleotide and phosphate-buffered saline or artificial cerebrospinal fluid.

9. A method comprising administering to an animal a pharmaceutical composition of claim 6.

10. A population of modified oligonucleotides of claim 3, wherein all of the phosphorothioate internucleoside linkages of the modified oligonucleotides are stereorandom.

11. A pharmaceutical composition comprising the modified oligonucleotide of claim 3 and a pharmaceutically acceptable diluent or carrier.

12. The pharmaceutical composition of claim 11, wherein the pharmaceutically acceptable diluent is phosphate-buffered saline or artificial cerebrospinal fluid.

13. The pharmaceutical composition of claim 11, wherein the pharmaceutical composition consists essentially of the modified oligonucleotide and phosphate-buffered saline or artificial cerebrospinal fluid.

14. A method comprising administering to an animal a pharmaceutical composition of claim 11.

15. A population of oligomeric compounds of claim 4, wherein all of the phosphorothioate internucleoside linkages of the modified oligonucleotides are stereorandom.

16. A pharmaceutical composition comprising the oligomeric compound of claim 4 and a pharmaceutically acceptable diluent or carrier.

17. The pharmaceutical composition of claim 16, wherein the pharmaceutically acceptable diluent is phosphate-buffered saline or artificial cerebrospinal fluid.

18. The pharmaceutical composition of claim 16, wherein the pharmaceutical composition consists essentially of the oligomeric compound and phosphate-buffered saline or artificial cerebrospinal fluid.

19. A method comprising administering to an animal a pharmaceutical composition of claim 16.

20. A method of treating Parkinson's disease comprising administering to a subject having or at risk for developing Parkinson's disease a therapeutically effective amount of a pharmaceutical composition according to claim 6, and thereby treating the Parkinson's disease.

21. The method of claim 20, wherein at least one symptom or hallmark of Parkinson's disease is ameliorated.

22. The method of claim 21, wherein the symptom or hallmark is any of ataxia, neuropathy, and aggregate formation.

23. The method of claim 20, wherein the subject is human.

24. A method of reducing expression of LRRK2 in a cell comprising contacting the cell with a modified oligonucleotide of claim 1.

25. The method of claim 24, wherein the cell is a human cell.

* * * * *

UNITED STATES PATENT AND TRADEMARK OFFICE
CERTIFICATE OF CORRECTION

PATENT NO. : 12,241,067 B2
APPLICATION NO. : 18/523746
DATED : March 4, 2025
INVENTOR(S) : Tracy A. Cole et al.

Page 1 of 15

It is certified that error appears in the above-identified patent and that said Letters Patent is hereby corrected as shown below:

In the Specification

In Columns 11-12, the structure should read:

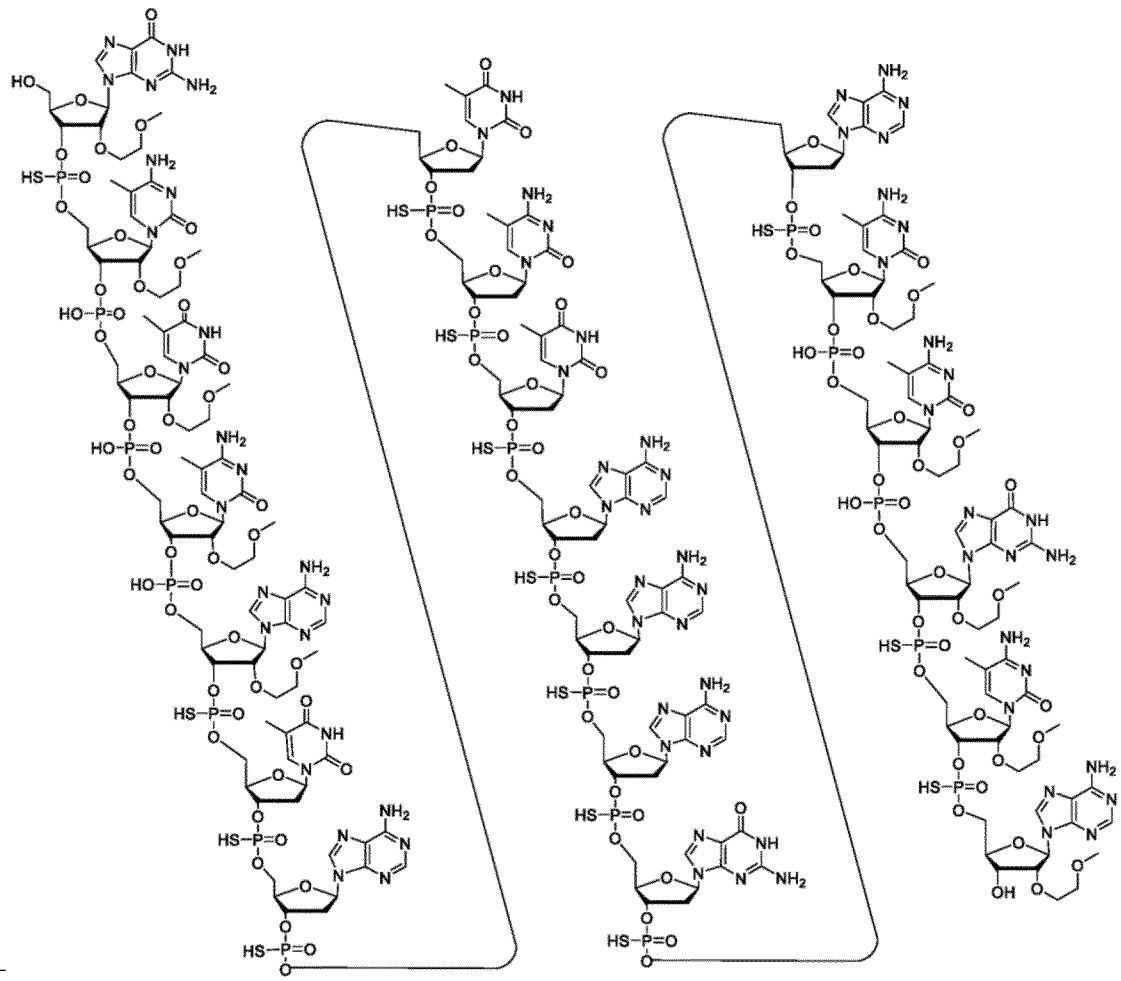

Signed and Sealed this
Third Day of June, 2025

Coke Morgan Stewart
*Acting Director of the United States Patent and Trademark Office*

CERTIFICATE OF CORRECTION (continued)
U.S. Pat. No. 12,241,067 B2

In Columns 57-60, Structure 1 should read:

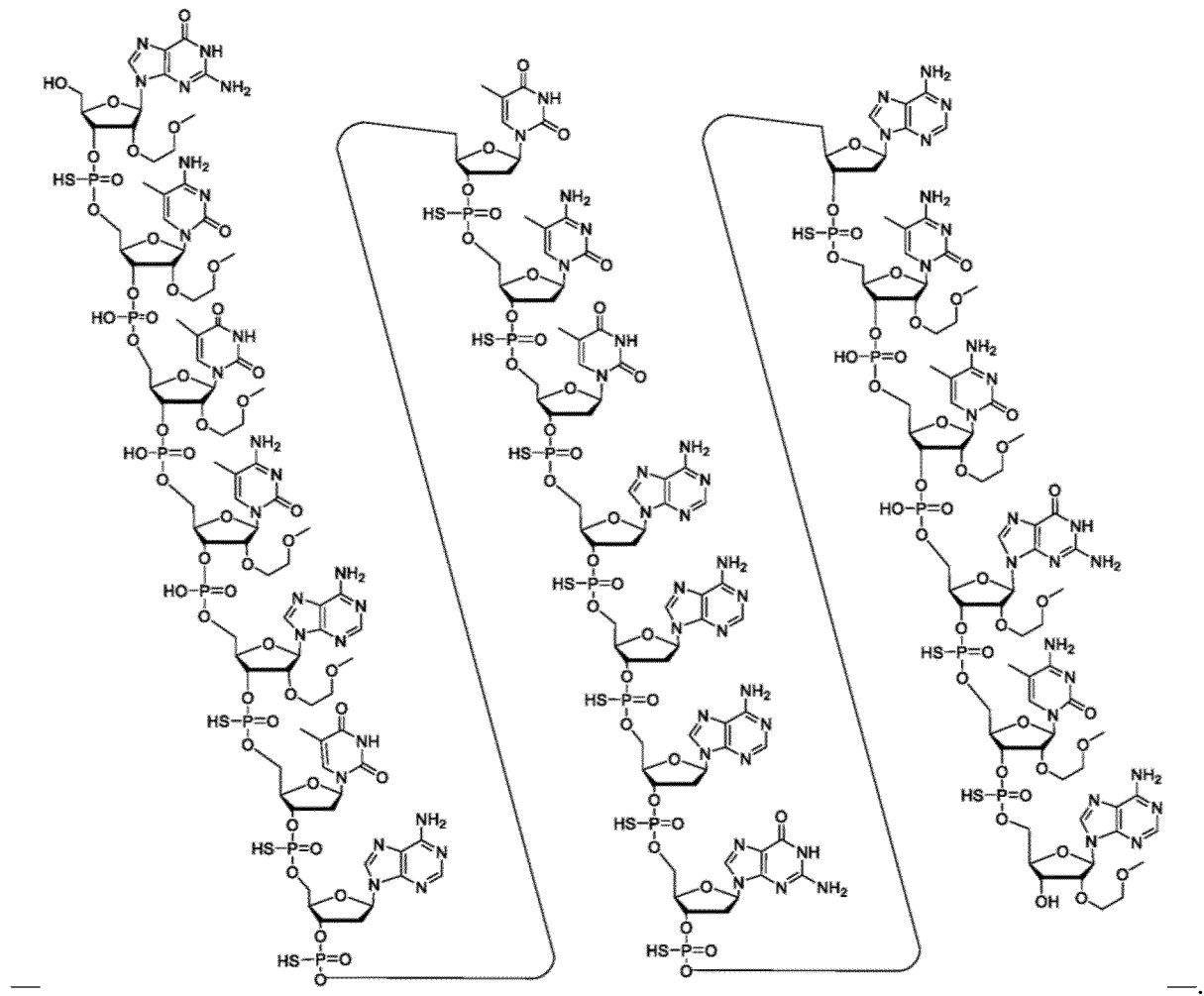

CERTIFICATE OF CORRECTION (continued)
U.S. Pat. No. 12,241,067 B2

In Columns 59-62, Structure 2 should read:

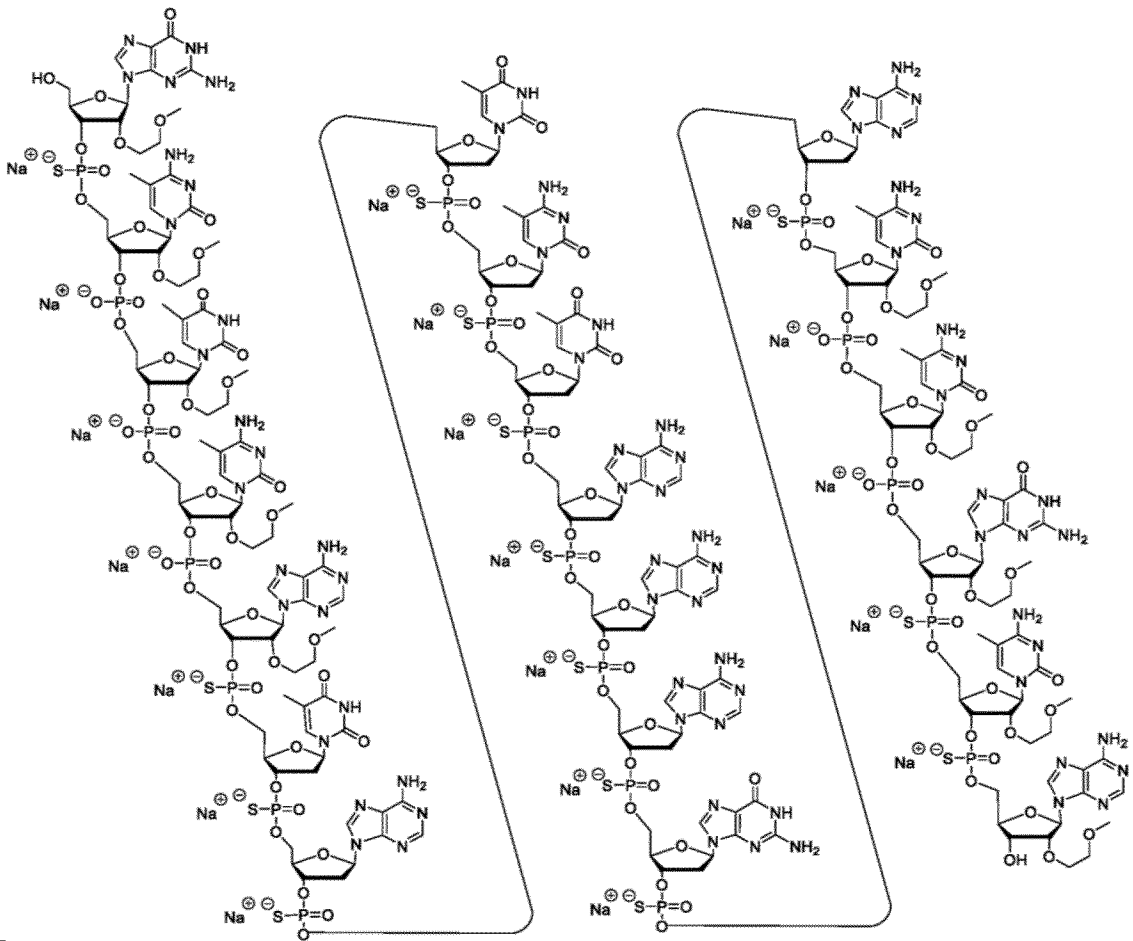

CERTIFICATE OF CORRECTION (continued)
U.S. Pat. No. 12,241,067 B2

In Columns 63-64, the structure should read:

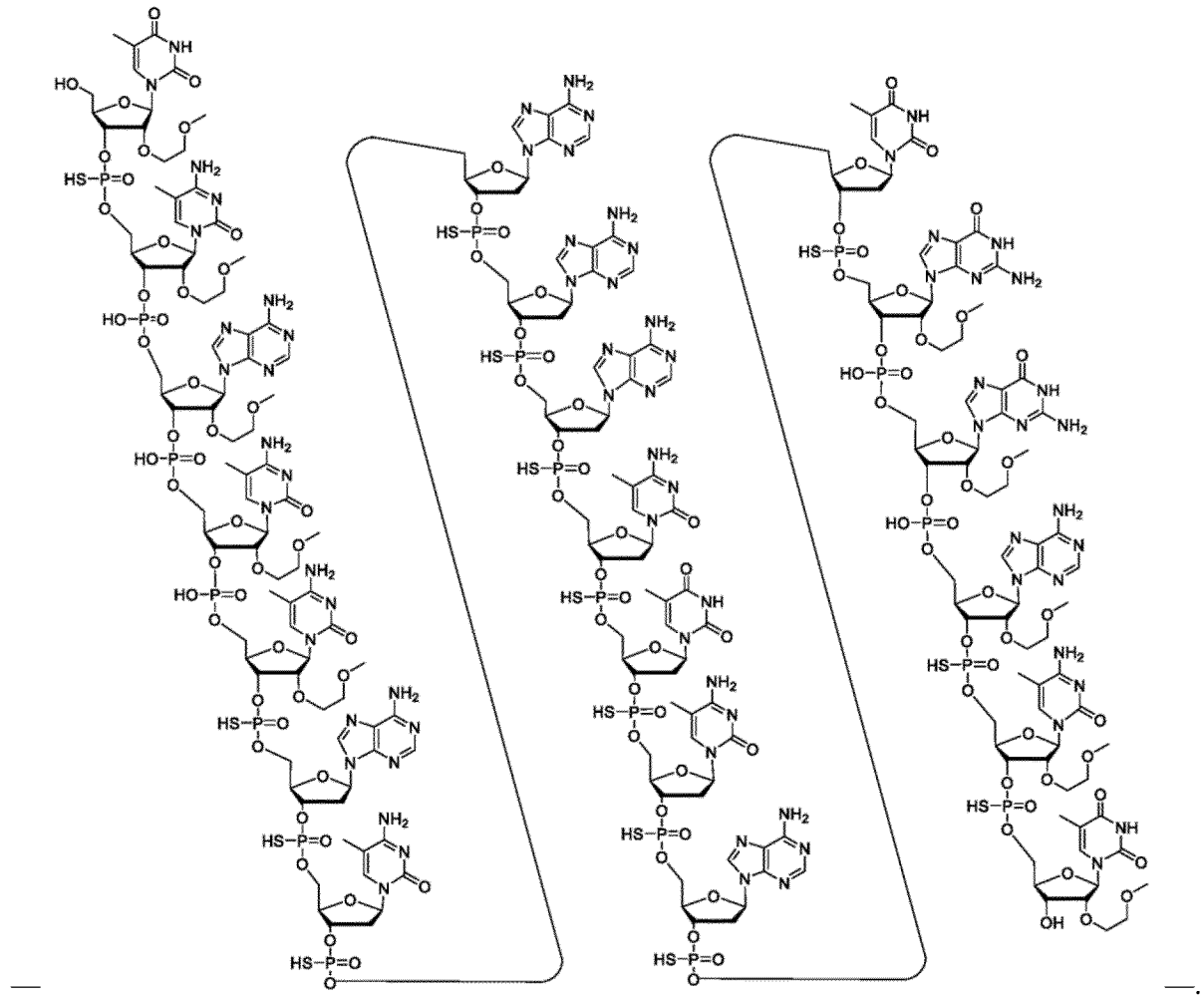

In Columns 65-66, the structure should read:
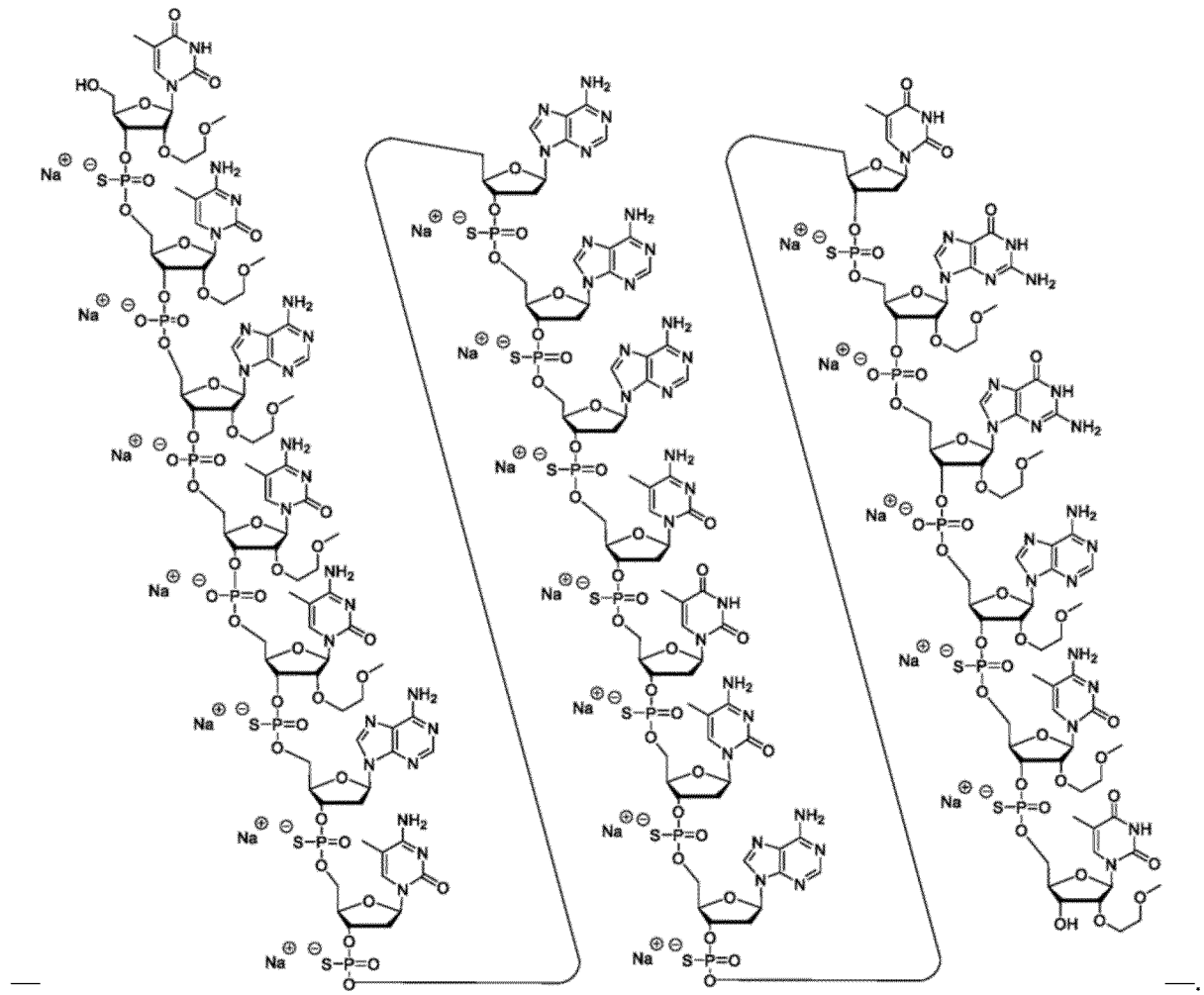

CERTIFICATE OF CORRECTION (continued)
U.S. Pat. No. 12,241,067 B2

In Columns 67-70, Structure 5 should read:

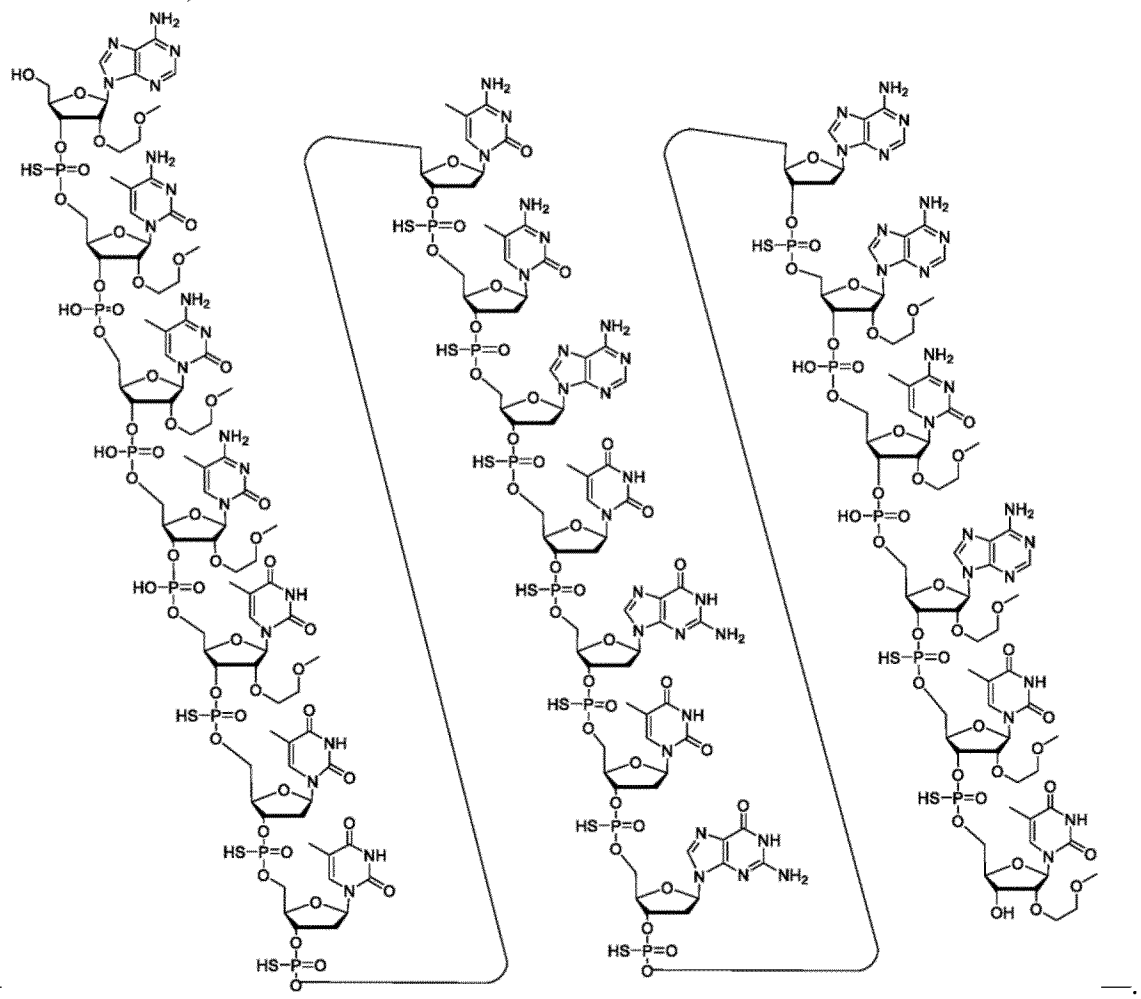

CERTIFICATE OF CORRECTION (continued)
U.S. Pat. No. 12,241,067 B2

In Columns 69-72, Structure 6 should read:

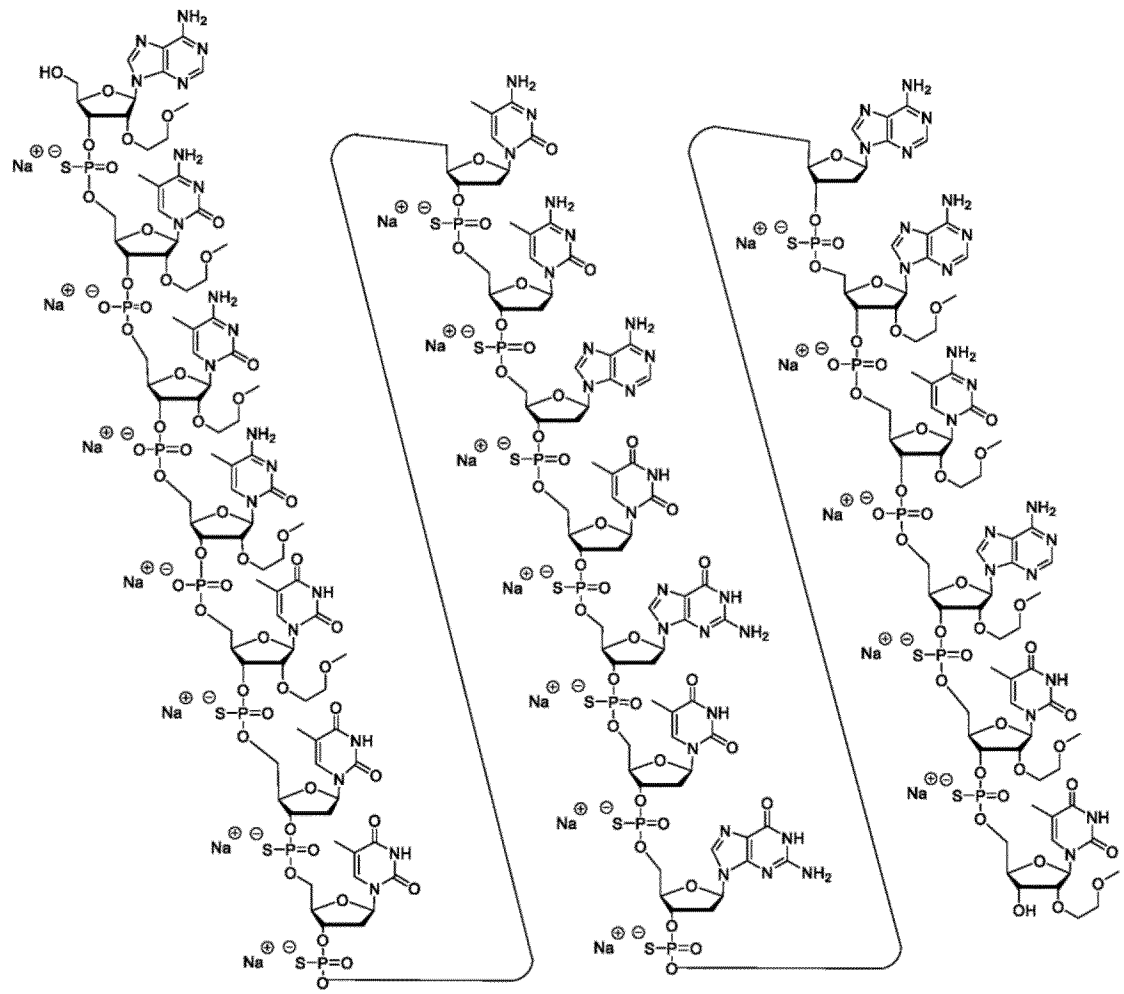

CERTIFICATE OF CORRECTION (continued)
U.S. Pat. No. 12,241,067 B2

In Columns 73-74, the structure should read:

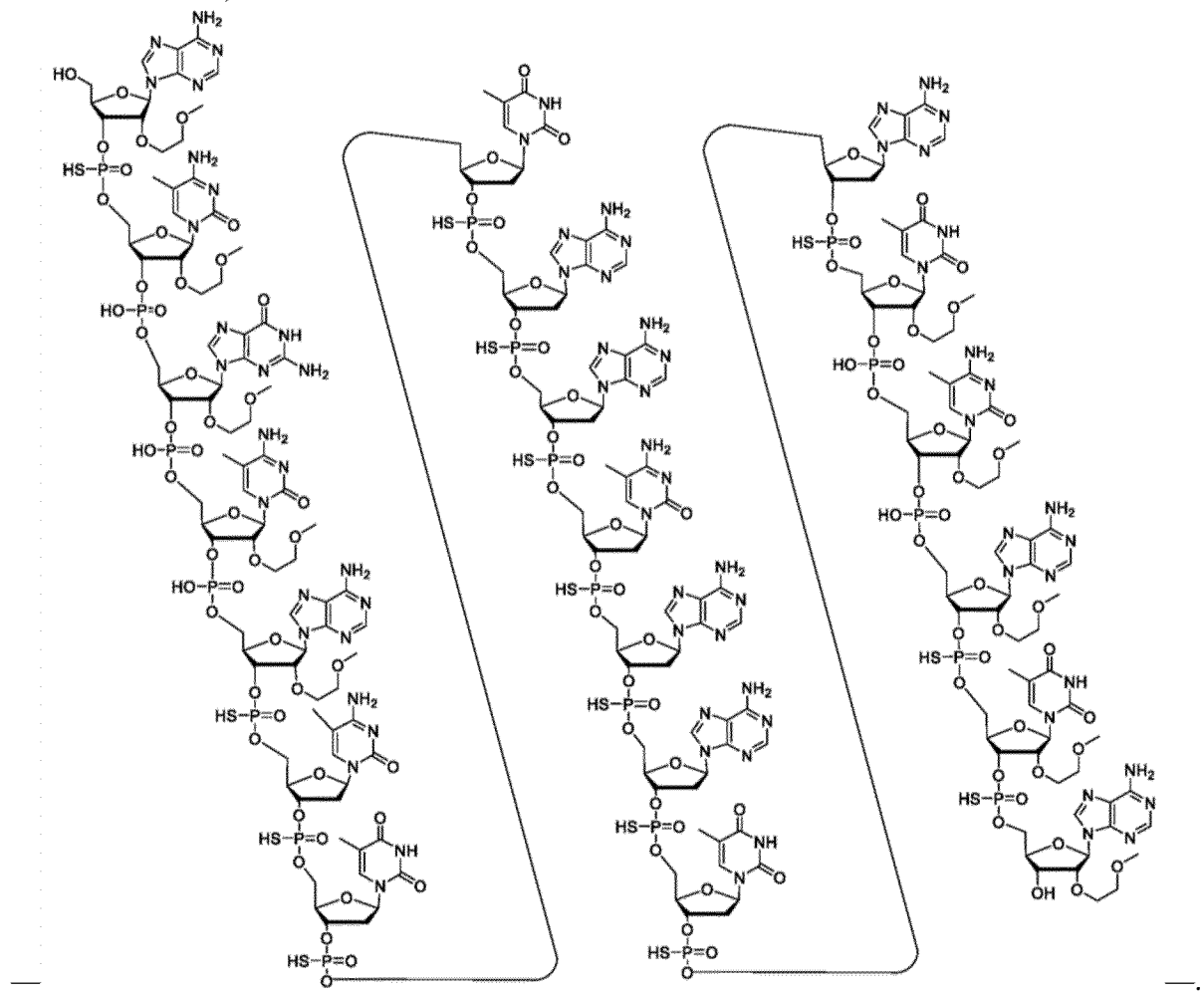

CERTIFICATE OF CORRECTION (continued)
U.S. Pat. No. 12,241,067 B2

In Columns 75-76, the structure should read:

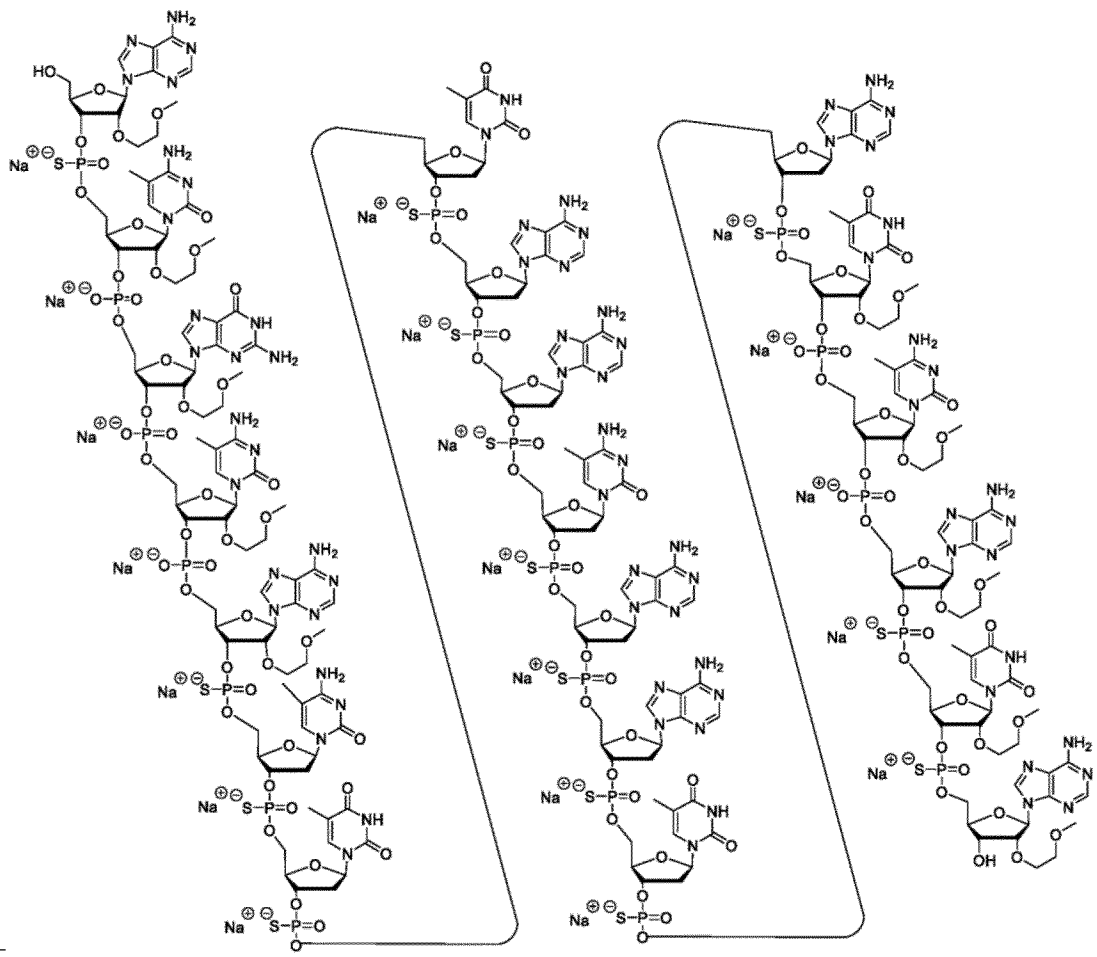

In Columns 77-78, the structure should read:
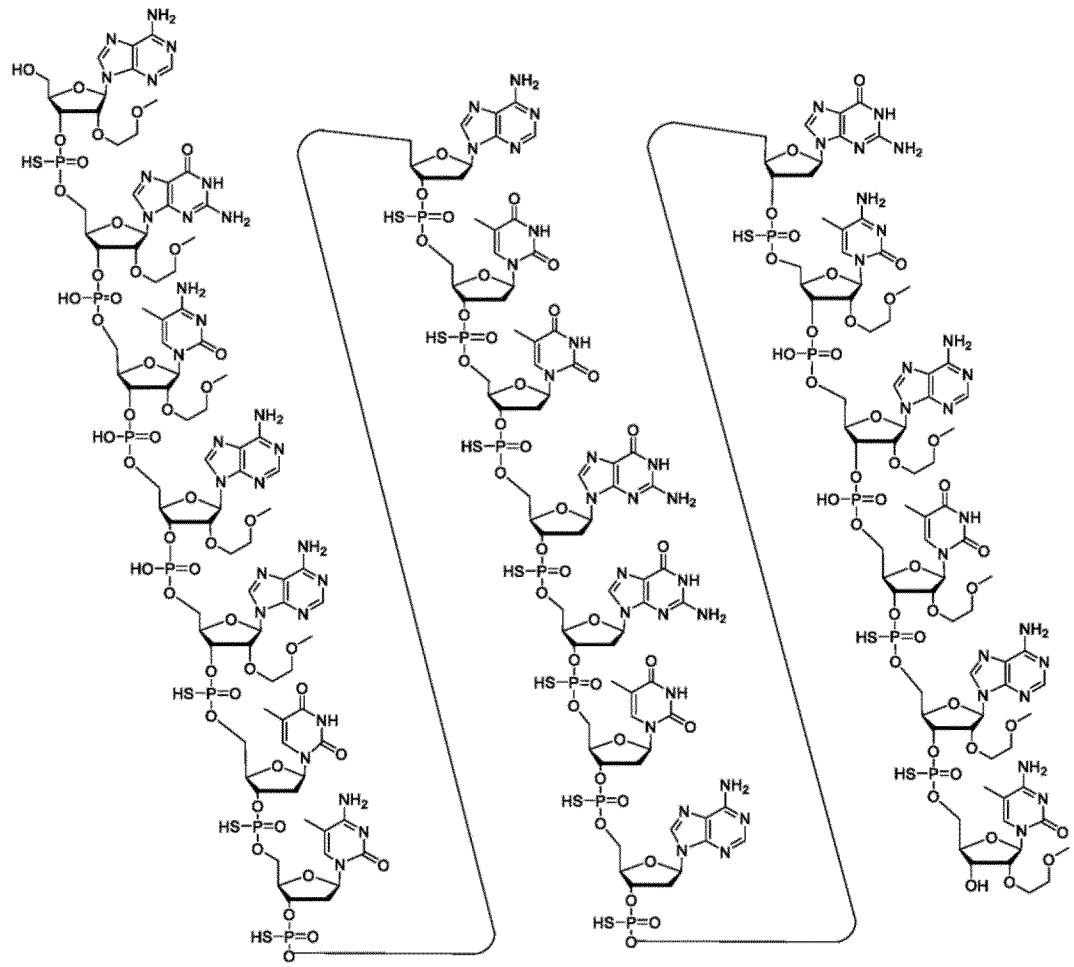

In Columns 79-80, the structure should read:
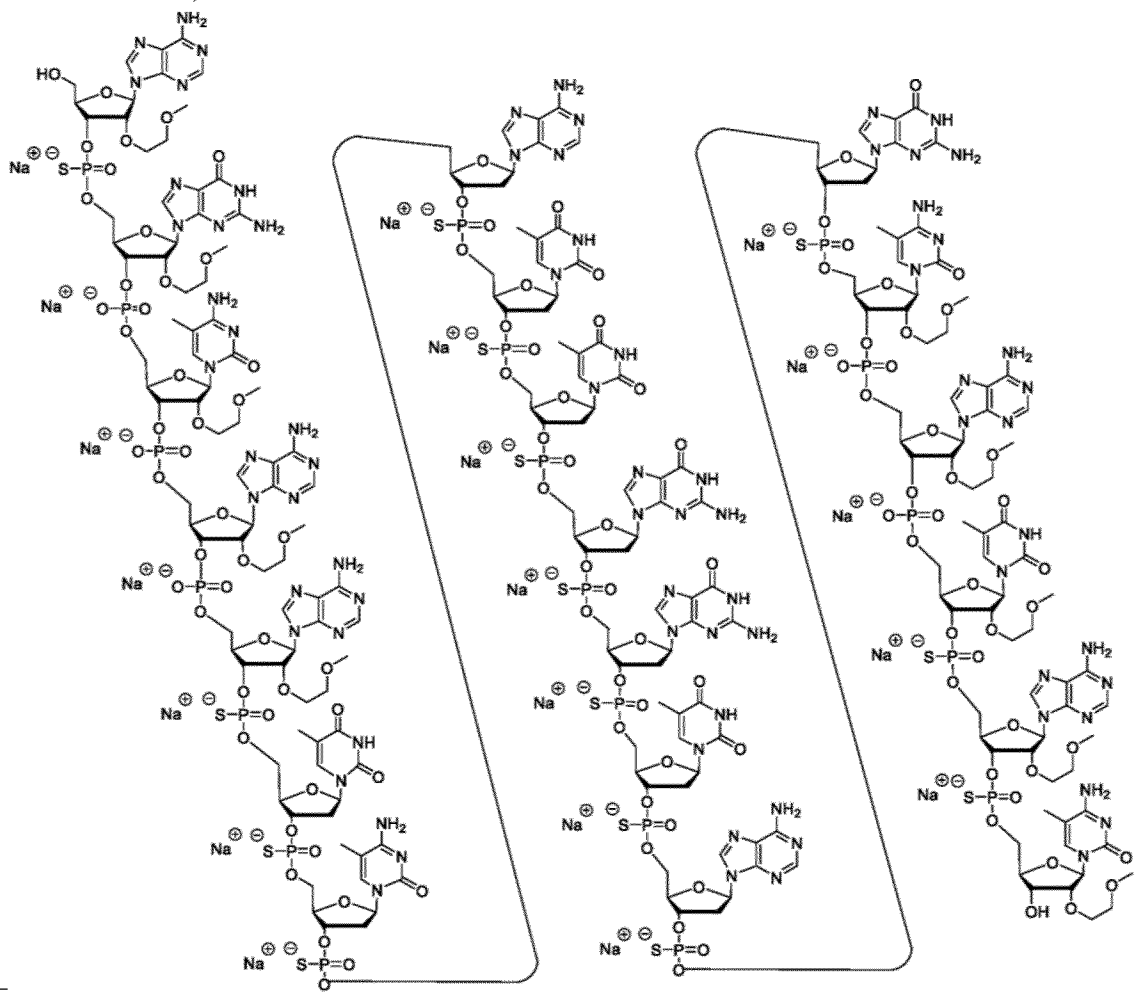

CERTIFICATE OF CORRECTION (continued)

In Columns 81-84, Structure 11 should read:

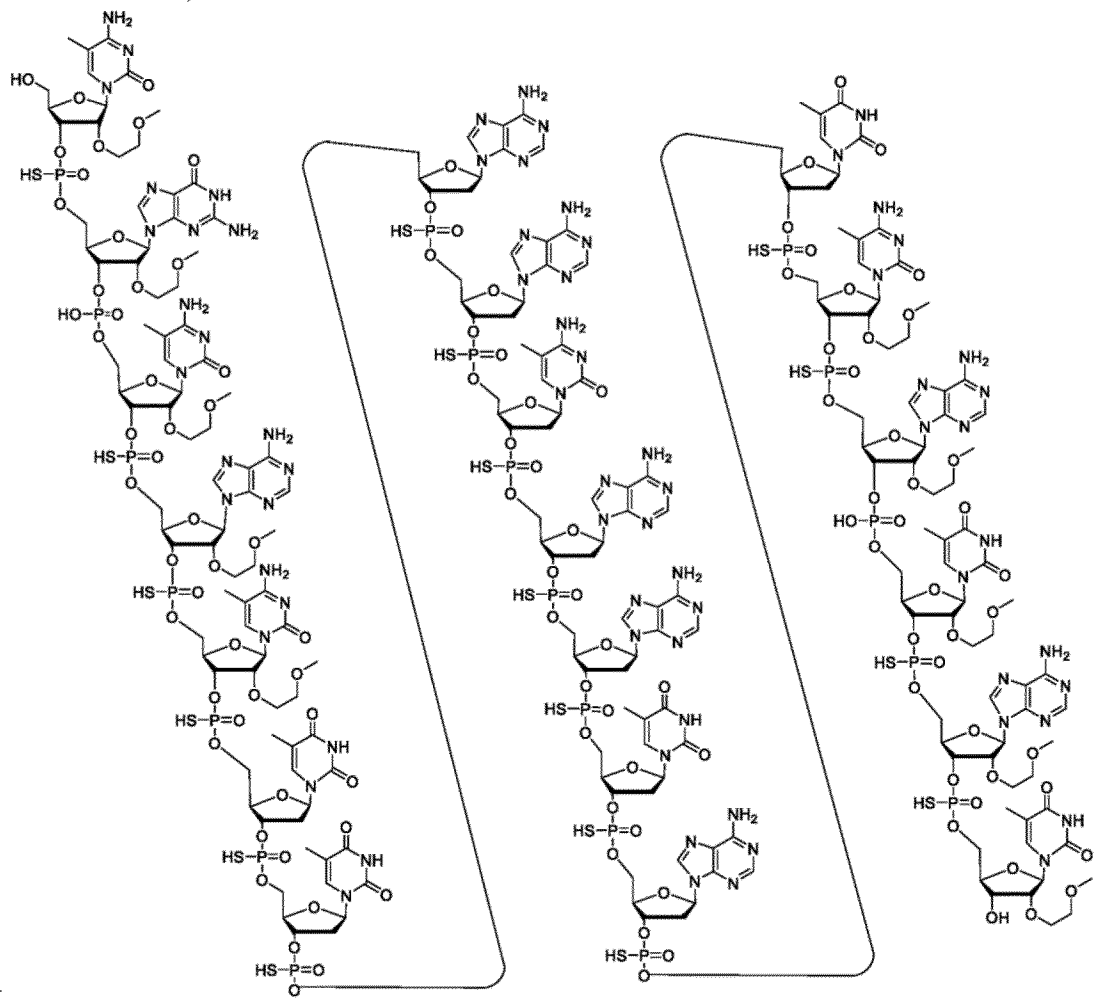

In Columns 83-86, Structure 12 should read:
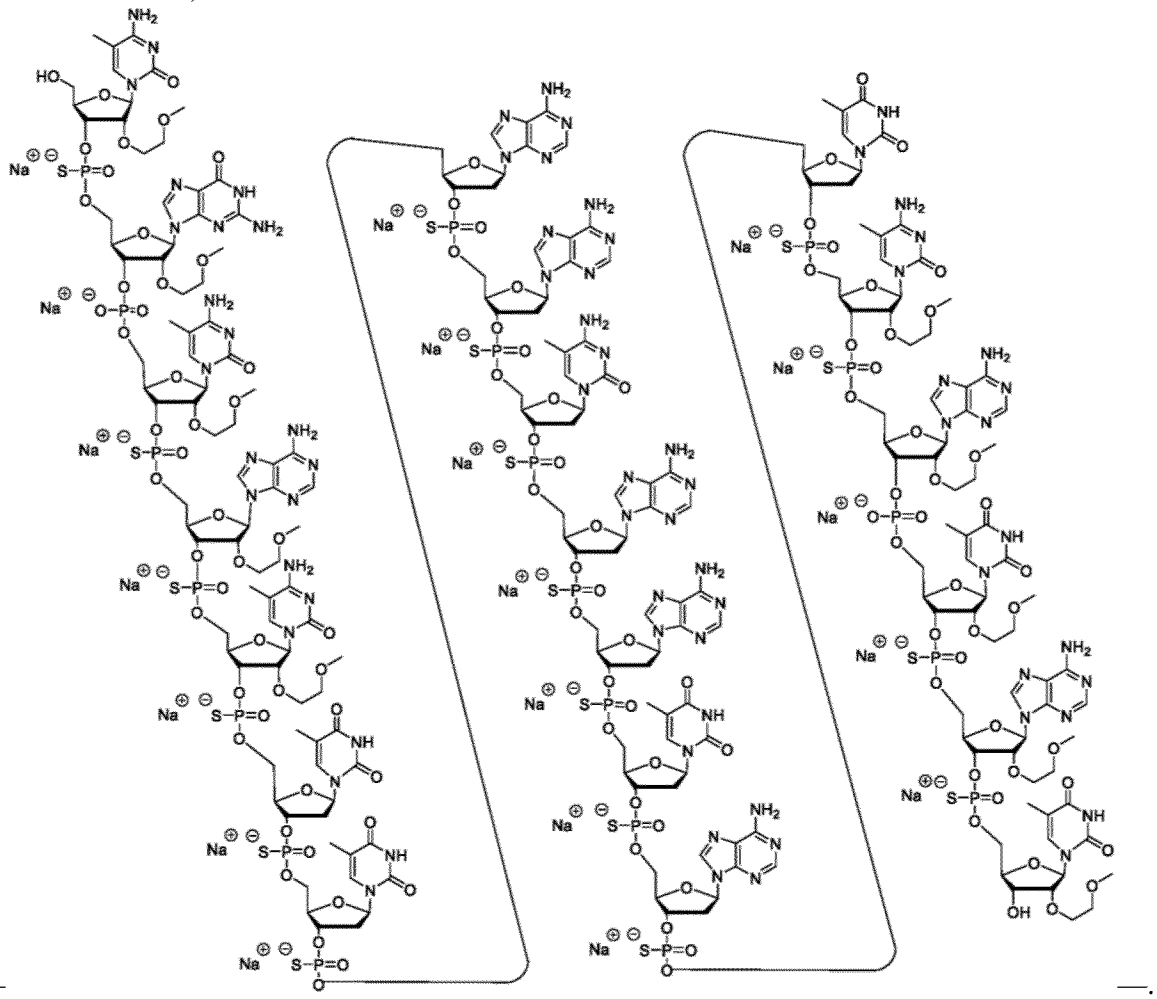
In the Claims
In Claim 1, Column 297, Line 36, "(SEQ ID NO: 3855)" should be deleted.
In Claim 1, Column 300, Line 63, —(SEQ ID NO: 3385)— should be replaced with —(SEQ ID NO: 3853)—.

In Claim 1, Columns 297-300, the structure should read:
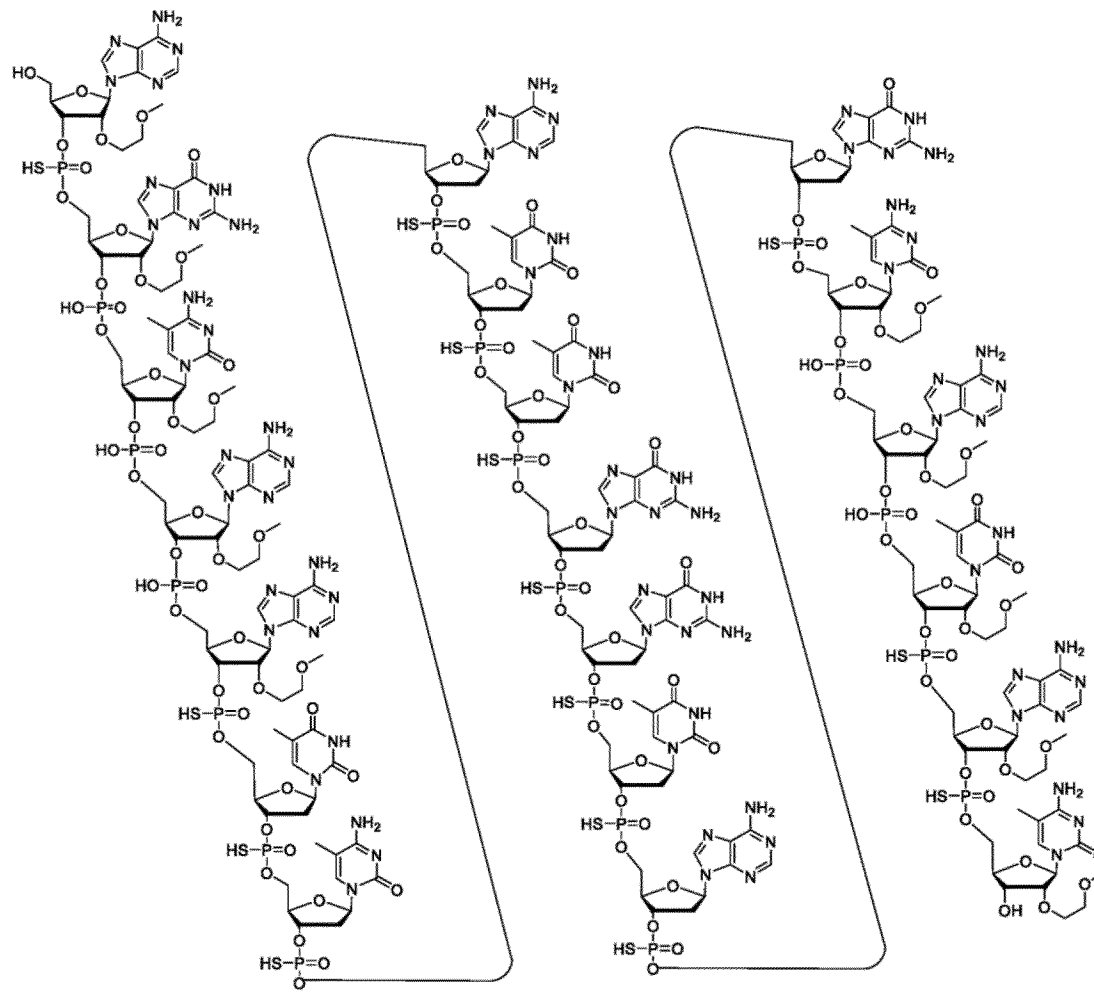
In Claim 3, Column 301, Line 61, —(SEQ ID NO: 3385)— should be replaced with —(SEQ ID NO: 3853)—.
In Claim 3, Column 302, Line 3, "(SEQ ID NO: 3855)" should be deleted.

CERTIFICATE OF CORRECTION (continued)
U.S. Pat. No. 12,241,067 B2

In Claim 3, Columns 301 and 302, the structure should read:

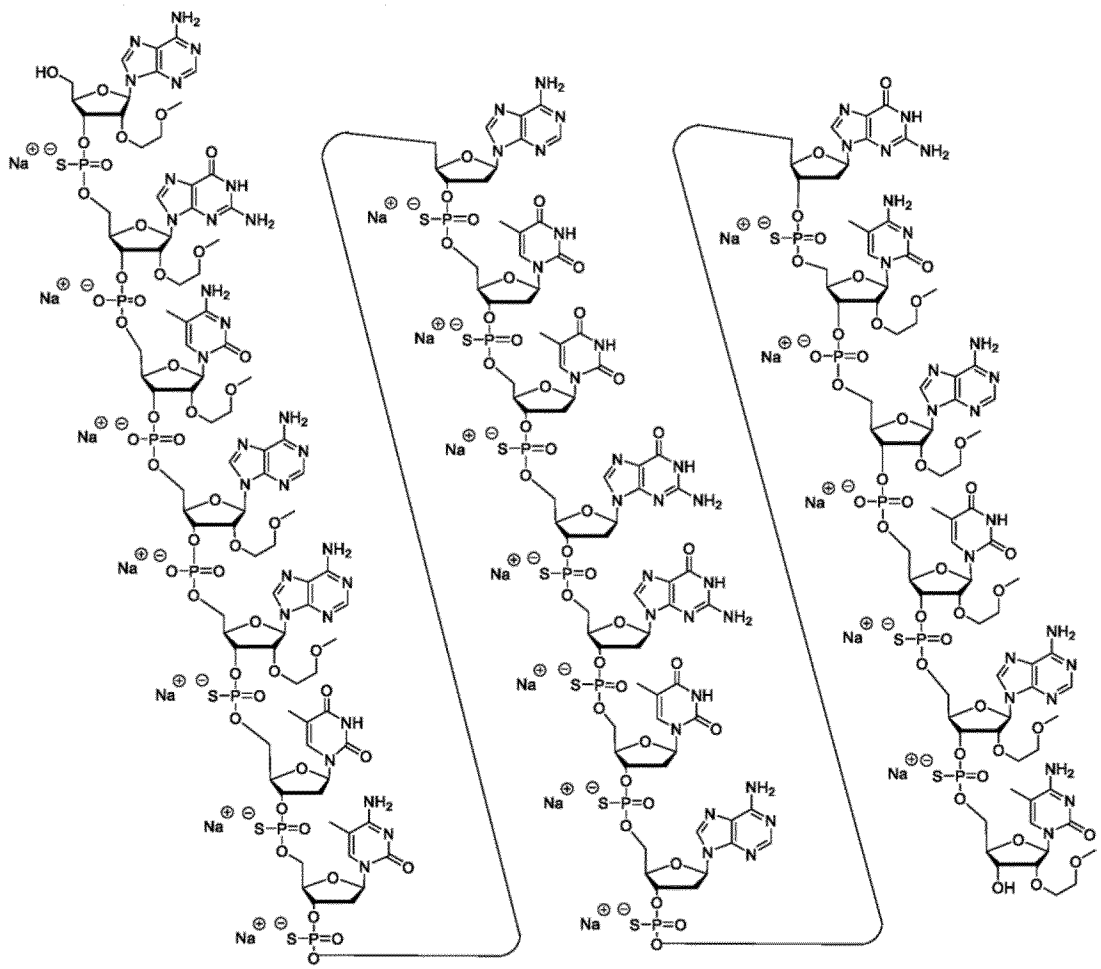

In Claim 4, Column 301, Line 67, —SEQ ID NO: 3385— should read —SEQ ID NO 3853—.